(12) United States Patent
Dumas Milne Edwards et al.

(10) Patent No.: US 7,060,479 B2
(45) Date of Patent: Jun. 13, 2006

(54) FULL-LENGTH HUMAN CDNAS ENCODING POTENTIALLY SECRETED PROTEINS

(75) Inventors: Jean-Baptiste Dumas Milne Edwards, Paris (FR); Lydie Bougueleret, Petit Lancy (CH); Severin Jobert, Paris (FR)

(73) Assignee: Serono Genetics Institute, S.A. (FR)

( * ) Notice: Subject to any disclaimer, the term of this patent is extended or adjusted under 35 U.S.C. 154(b) by 640 days.

(21) Appl. No.: 09/876,997

(22) Filed: Jun. 8, 2001

(65) Prior Publication Data

US 2003/0152921 A1 Aug. 14, 2003

Related U.S. Application Data

(63) Continuation-in-part of application No. 09/731,872, filed on Dec. 7, 2000, now abandoned.
(60) Provisional application No. 60/169,629, filed on Dec. 8, 1999, and provisional application No. 60/187,470, filed on Mar. 6, 2000.

(51) Int. Cl.
| | |
|---|---|
| *C12N 9/16* | (2006.01) |
| *C12Q 1/42* | (2006.01) |
| *C12P 21/06* | (2006.01) |
| *C07K 1/00* | (2006.01) |
| *C07H 21/04* | (2006.01) |

(52) U.S. Cl. .................. 435/196; 435/21; 435/69.1; 435/320.1; 435/252.3; 435/325; 536/23.2; 530/350

(58) Field of Classification Search ............. 435/196, 435/21, 69.1, 320.1, 252.3; 530/350; 536/23.2
See application file for complete search history.

(56) References Cited

U.S. PATENT DOCUMENTS

| 4,914,025 A | 4/1990 | Manoil et al. |
|---|---|---|
| 5,019,369 A | 5/1991 | Presant et al. |
| 5,536,637 A | 7/1996 | Jacobs |
| 5,872,141 A | 2/1999 | Umbreit et al. |
| 6,034,062 A | 3/2000 | Thies et al. |
| 6,110,490 A | 8/2000 | Thierry |
| 6,204,060 B1 | 3/2001 | Mehtali et al. |
| 6,242,179 B1 | 6/2001 | Shah et al. |

FOREIGN PATENT DOCUMENTS

| EP | 1130094 A2 | 7/2000 |
|---|---|---|
| WO | WO 97/18826 A2 | 7/1995 |
| WO | WO 97/04097 A2 | 2/1997 |
| WO | WO 97/07198 A2 | 2/1997 |
| WO | WO 98/55614 A2 | 12/1998 |

OTHER PUBLICATIONS

Bork, Genome Research, 10:398–400, 2000.*
Broun et al., Science 282:1315–1317, 1998.*
Seffernick et al., J. Bacteriol. 183(8):2405–2410, 2001.*
Van de Loo et al., Proc. Natl. Acad. Sci. 92:6743–6747, 1995.*
Witkowski et al., Biochemistry 38:11643–11650, 1999.*
Attwood, Science 290(5491):471–473, 2000.*
Zheng, B. et al., MIR16, a putative membrane glycerophosphodiester phosphodiesterase, Interacts with RGS16, *Proc. Natl. Acad. Sci. U.S.A.* (2000), pp. 3999–4004, vol. 97, No. 8, Accession No. AAF65234 (bases 1 to 331).
Zheng, B. et al., MIR16, a putative membrane glycerophosphodiester phosphodiesterase, interacts with RGS16, *Proc. Natl. Acad. Sci. U.S.A.* (2000), pp. 3999–4004, vol. 97, No. 8, Accession No. AF212862 (bases 1 to 1200).
Glycerophosphoryl Diester Phosphodiesterase *Escherichia coli* (1989), NiceProt View of SWISS–PROT: P10908.
Glycerophosphoryl Diester Phosphodiesterase, periplasmic [Precursor] *Escherichia coli* (1991), NiceProt View of SWISS–PROT: P09394.
Glycerophosphoryl Diester Phosphodiesterase [Precursor] *Haemophilus influenzae* (1995), NiceProt View of SWISS–PROT: Q06282.
Similar to G Protein Gamma 3 Linked Gene *Homo sapiens* (2001), NiceProt View of SWISS–PROT: Q9BSQ0.
Hypothetical 43.1 kDa protein *Mus musculus* (2000), NiceProt View of SWISS–PROT: Q9JMF1.
Bougueleret, L. et al., "Extended cDNAs useful for expressing secreted proteins and to obtain specific antibodies", 2000, pp. 203–204, Accession No. AAY6985.
Cameron, C. et al., "Function and Protective Capacity of *Treponema pallidum* subsp. *pallidum* Glycerophosphodiester Phosphodiesterase", *Infection and Immunity* (1998), pp. 5763–5770, vol. 66, No. 12, American Society for Microbiology.
Downes, G. et al., "Structure and Mapping of the G Protein γ3 Subunit Gene and a Divergently Transcribed Novel Gene, *Gng3lg*", *Genomics* (1998), pp. 220–230, vol. 53, Academic Press.
Inoue, S. et al., "Growth Suppression of *Escherichia coli* by induction of Expression of Mammalian Genes with Transmembrane or ATPase Domains", *Biochem. Bioaphys. Reas. Comm.* (2000), pp. 563–561, vol. 268, Academic Press.

(Continued)

*Primary Examiner*—Rebecca E. Prouty
*Assistant Examiner*—Delia M. Ramirez
(74) *Attorney, Agent, or Firm*—Saliwanchik, Lloyd & Saliwanchik

(57) ABSTRACT

The invention concerns GENSET polynucleotides and polypeptides. Such GENSET products may be used as reagents in forensic analyses, as chromosome markers, as tissue/cell/organelle-specific markers, in the production of expression vectors. In addition, they may be used in screening and diagnosis assays for abnormal GENSET expression and/or biological activity and for screening compounds that may be used in the treatment of GENSET-related disorders.

7 Claims, 5 Drawing Sheets

OTHER PUBLICATIONS

Janson, H., et al., "Protein D, the Glycerophosphodiester Phosphodiesterase from *Haemophilua influenzae* with Affinity for Human Immunoglobulin D, Influences Virulence in a Rat Otitis Model", *Infection and Immunity*, 1994, pp. 4848–4854, vol. 62, No. 11, American Society for Microbiology.

Larson, T., et al., "Periplasmic Glycerophosphodiester Phosphodiesterase of *Escherichia coli*, a New Enzyme of the glp Regulon", *J. Biol. Chem.*, 1983, pp. 5428–5432, vol. 258, No. 9.

Magré, J. et al., "Identification of the gene altered in Berardinelli–Seip congenital lipodystrophy on chromosome 11q13", *Nature Genetics* (2001), pp. 365–370, vol. 28.

Meldrum, Brian, "Glutamate as a Nourotransmitter in the Brain: Review of Physiology and Pathology", *The Journal of Nutrition—Supplement* (presented at the International Symposium on Glutamate, 1998), 2000, pp. 1007S–1015S, Pub: American Society for Nutritional Sciences.

Munson, R. et al., "Protein D. a Putative Immunoglobulin D–Binding Protein Produced by *Haemophilus influenzae*, is Glycerophosphodiester Phosphodiesterase", *J. Bacteriology*, 1993, pp. 4569–4571, vol. 175, No. 14.

Neer, Eva, "Heterotrimeric G Proteins: Organizers of Transmembrane Signals", *Cell*, 1995, pp. 249–257, vol. 80, Cell Press.

Schoepp, D. et al., "Metabotropic glutamate receptors in brain function and pathology", *TiPS*, 1993, pp. 13–20, vol. 14, Elsevier Science Publishers, Ltd., UK.

Zheng, B. et al., MIR16, a putative membrane glycerophosphodiester phosphodiesterase, interacts with RGS16, *PNAS*, 2000, pp. 3999–4004, vol. 97, No. 8.

Marra, M., et al.; Accession No. W08383; "The WashU–HHMI Mouse EST Project"; XP002032348, 1996.

Marra, M., et al.; Accession No. W11170; "The WashU–HHMI Mouse EST Project"; XP002032350, 1997.

Marra, M., et al.; Accession No. W17930; "The WashU–HHMI Mouse EST Project"; XP002032349, 1996.

Marra, M., et al.; Accession No. W67046; "The WashU–HHMI Mouse EST Project"; XP002032347, 1996.

Database GENESEQ [Online] AC No. Y76144, Mar. 23, 2000; Ruben S.M., et al.; "Human secreted protein encoded by gene 21"; XP002163702.

Database GENESEQ [Online] AC No. Z65270, Mar. 23, 2000; Ruben S.M., et al.; "Human secreted protein gene 21"; XP002163703.

Database EMBL[Online] AC No. AI911546; Jul. 30, 1999; Natl. Cancer Inst.; "ty73d05.x1 NCI_CGAP_Kid11 Homo sapiens cDNA cione IMAGE:2284713"; XP002163704.

Database EMBL [Online] AC No. AI361251; Jan. 7, 1999; Natl. Cancer Inst.; qy42e02.x1 NCI_CGAP_Bm23 Homo sapiens cDNA clone IMAGE:2014682; XP002163705.

Jacobs, K.A., et al.; "A genetic selection for isolating cDNAs encoding secreted proteins"; Gene, NL, Elsevier Biomedical Press., Amsterdam, vol. 198, Oct. 1, 1987; pp. 289–296; XP002045919.

Tashiro, K., et al.; "Signal Sequence Trap: A Cloning Strategy for Secreted Proteins and Type I Membrane Proteins"; Science; U.S., American Association for the Advancement of Science; vol. 261; Jul. 30, 1993; pp. 600–603; XP000673204.

Lim, E.M., et al.; "Identification of *Mycobacterium tuberculosis* DNA Sequences Encoding Exported Proteins by Using phoA Gene Fusions"; Journal of Bacteriology, Jan. 1995, vol. 177, No. 1; pp. 59–650021–9193/95; XP000560419.

Miyake, et al.; "RP105, a Novel B Cell Surface Molecule Implicated in B Cell Activation, is a Member of the Leucine–Rich Repeat Protein Family"; The Journal of Immunology, pp. 3333–3340; The American Asociation of Immunologists; 0022–1767/95, 1995.

Tashiro, et al.; "Signal Sequence Trap: A Cloning Strategy for Secreted Proteins and Type I Membrane Proteins"; Science, vol. 261; Jul. 30, 1993; pp. 600–603.

Fujiwara, T., et al., Accession No. D62634; "HUM309B01B Clontech human aorta polyA+ mRNA (#6572) Homo sapiens cDNA clone GEN–309B01 5', mRNA sequence"; XP002032351, 1995.

Database GENBANK, Accession No. NP_803133; Ishikawa, T., et al., "Cell surface activities of the human type 2b phosphatidic acid phosphatase", *J. Biochem.*, 2000, pp. 645–651, vol. 127, Issue 4.

Database GENBANK, Accession No. NP_808211; Zhang, N., et al., "Mice mutant for Ppap2c, a homolog of the germ cell migration regulator wumen, are viable and fertile", *Genesis*, 2000, pp. 137–140, vol. 27, Issue 4.

Accession No. AAB70690, Human hDPP protein sequence SEQ ID No:May 17, 2001.

Jacobs, K. et al. "A Novel Method for Isolating Eukaryotic cDNA Clones Encoding Secreted Proteins", *Dendritic Cells: Antigen Presenting Cells of T and B Lymphocytes*, Mar. 10–16, 1995, p. C1–207.

Abraham, E., et al., "Phosphatidic Acid Signaling Mediates Lung Cytokine Expression and Lung Inflammatory Injury After Hemorrhage in Mice", *J. Exp. Med.*, 1995, pp. 569–575, vol. 181.

Brindley, D. and Waggoner, D. "Phosphatidate phosphohydrolase and signal transduction"; *Chem. Phys. Lipids*, 1996, pp. 45–57, vol. 80.

Bursten, S., et al., "Potential Role for Phosphatidic Acid in Mediating the Inflammatory Responses to TNFα and IL–1β", *Circ. Shock*, 1994, pp. 14–29, vol. 44.

English, D., "Phosphatidic Acid: A Lipid Messenger Involved in Intracellular and Extracellular Signalling", *Cell. Signal.*, 1996, pp. 341–347, vol. 8, No. 5.

English, D., et al., "Messenger functions of phosphatidic acid", *Chem. Phys. Lipids*, 1996, pp. 117–132, vol. 80.

Kent, C. "Eukaryotic Phospholipid Biosynthesis", *Ann. Rev. Biochem.*, 1995, pp. 315–343, vol. 64.

Leung, D., et al., "CT–2576, an inhibitor of phospholipids signaling, suppresses constitutive and induced expression of human immunodeficiency virus", *Proc. Natl. Acad. Sci. USA*, 1995, pp. 4813–4817, vol. 92.

Rice, G., et al., "Protection from endotoxic shock in mice by pharmacologic inhibition of phosphatidic acid", *Proc. Natl. Acad. Sci. USA*, 1994, 3857–3861, vol. 91.

Roberts, R. and Morris, A. "Role of phosphatidic acid phosphatase 2a in uptake of extracellular lipid phosphate mediators", *Biochimica et Biophysica Acta*, 2000, pp. 33–49, vol. 1487.

Salvador, G.A., et al., "Differential modulation of phospholipase D and phosphatidate phosphohydrolase during aging in rat cerebral cortex synaptosomes", *Exp. Gerontology*, 2002, pp. 543–552, vol. 37.

Stukey, J. and Carman, G. "Identification of a novel phosphatase sequence motif", *Protein Science*, 1997, pp. 469–472, vol. 6.

Database GENBANK, Accession NP_003702; Pandey, A.V., et al., "Protein phosphatase 2A and phosphoprotein SET regulate androgen production by p450c17", *J. Biol. Chem.*, 2003, pp. 2837–2844, vol. 278, Issue 5.

Database GENBANK, Accession No. NP_795714; Pandey, A.V., et al., "Protein phosphatase 2A and phosphoprotein SET regulate androgen production by p450c17", *J. Biol. Chem.*, 2003, pp. 2837–2844, vol. 278, Issue 5.

\* cited by examiner

FULL-LENGTH HUMAN CDNAS ENCODING POTENTIALLY SECRETED PROTEINS

RELATED APPLICATION

The present application is a continuation-in-part application of U.S. Ser. No. 09/731,872, filed Dec. 7, 2000, now abandoned, which claims priority, under 35 USC §119(e), to the U.S. Provisional Patent Applications Ser. No. 60/169,629 and 60/187,470 filed Dec., 8, 1999, and Mar., 6, 2000, respectively, the disclosures of which are incorporated herein by reference in their entireties.

FIELD OF THE INVENTION

The present invention is directed to polynucleotides encoding GENSET polypeptides, fragments thereof, and the regulatory regions located in the 5'- and 3'-ends of the GENSET genes. The invention also concerns polypeptides encoded by the GENSET polynucleotides and fragments thereof. The present invention also relates to recombinant vectors, which include the polynucleotides of the present invention, particularly recombinant vectors comprising a GENSET regulatory region or a sequence encoding a GENSET polypeptide, and to host cells containing the polynucleotides of the invention, as well as to methods of making such vectors and host cells. The present invention further relates to the use of these recombinant vectors and host cells in the production of the polypeptides of the invention. The invention further relates to antibodies that specifically bind to the polypeptides of the invention and to methods for producing such antibodies and fragments thereof. The invention also provides for methods of detecting the presence of the polynucleotides and polypeptides of the present invention in a sample, methods of diagnosis and screening of abnormal GENSET gene expression and/or biological activity, methods of screening compounds for their ability to modulate the activity or expression of GENSET genes and uses of such compounds.

BACKGROUND OF THE INVENTION

The estimated 50,000–100,000 genes scattered along the human chromosomes offer tremendous promise for the understanding, diagnosis, and treatment of human diseases. In addition, probes capable of specifically hybridizing to loci distributed throughout the human genome find applications in the construction of high resolution chromosome maps and in the identification of individuals.

Currently, two different approaches are being pursued for identifying and characterizing the genes distributed along the human genome. In one approach, large fragments of genomic DNA are isolated, cloned, and sequenced. Potential open reading frames in these genomic sequences are identified using bio-informatics software. However, this approach entails sequencing large stretches of human DNA which do not encode proteins in order to find the protein encoding sequences scattered throughout the genome. In addition to requiring extensive sequencing, the bio-informatics software may mischaracterize the genomic sequences obtained, i.e., labeling non-coding DNA as coding DNA and vice versa.

An alternative approach takes a more direct route to identifying and characterizing human genes. In this approach, complementary DNAs (cDNAs) are synthesized from isolated messenger RNAs (mRNAs) which encode human proteins. Using this approach, sequencing is only performed on DNA which is derived from protein coding fragments of the genome. In the past, these cDNAs, ofter short EST sequences were obtained from oligo-dT primed cDNA libraries. Accordingly, they mainly corresponded to the 3' untranslated region of the mRNA. In part, the prevalence of EST sequences derived from the 3' end of the mRNA is a result of the fact that typical techniques for obtaining cDNAs, are not well suited for isolating cDNA sequences derived from the 5' ends of mRNAs (Adams et al., *Nature* 377:3–174, 1996, Hillier et al., *Genome Res.* 6:807–828, 1996). In addition, in those reported instances where longer cDNA sequences have been obtained, the reported sequences typically correspond to coding sequences and do not include the full 5' untranslated region (5'UTR) of the mRNA from which the cDNA is derived. Indeed, 5'UTRs have been shown to affect either the stability or translation of mRNAs. Thus, regulation of gene expression may be achieved through the use of alternative 5'UTRs as shown, for instance, for the translation of the tissue inhibitor of metalloprotease mRNA in mitogenically activated cells (Waterhouse et al., *J Biol Chem.* 265:5585–9, 1990). Furthermore, modification of 5'UTR through mutation, insertion or translocation events may even be implied in pathogenesis. For instance, the fragile X syndrome, the most common cause of inherited mental retardation, is partly due to an insertion of multiple CGG trinucleotides in the 5'UTR of the fragile X mRNA resulting in the inhibition of protein synthesis via ribosome stalling (Feng et al., *Science* 268:73–4, 1995). An aberrant mutation in regions of the 5'UTR known to inhibit translation of the proto-oncogene c-myc was shown to result in upregulation of c-myc protein levels in cells derived from patients with multiple myelomas (Willis et al., *Curr Top Microbiol Immunol* 224:269–76, 1997). In addition, the use of oligo-dT primed cDNA libraries does not allow the isolation of complete 5'UTRs since such incomplete sequences obtained by this process may not include the first exon of the mRNA, particularly in situations where the first exon is short. Furthermore, they may not include some exons, often short ones, which are located upstream of splicing sites. Thus, there is a need to obtain sequences derived from the 5' ends of mRNAs.

Moreover, despite the great amount of EST data that large-scale sequencing projects have yielded (Adams et al., *Nature* 377:174, 1996, Hillier et al., *Genome Res.* 6:807–828, 1996), information concerning the biological function of the mRNAs corresponding to such obtained cDNAs has revealed to be limited. Indeed, whereas the knowledge of the complete coding sequence is absolutely necessary to investigate the biological function of mRNAs, ESTs yield only partial coding sequences. So far, large-scale full-length cDNA cloning has been achieved only with limited success because of the poor efficiency of methods for constructing full-length cDNA libraries. Indeed, such methods require either a large amount of mRNA (Ederly et al., 1995), thus resulting in non representative full-length libraries when small amounts of tissue are available or require PCR amplification (Maruyama et al., 1994; CLONTECHniques, 1996) to obtain a reasonable number of clones, thus yielding strongly biased cDNA libraries where rare and long cDNAs are lost. Thus, there is a need to obtain full-length cDNAs, i.e. cDNAs containing the full coding sequence of their corresponding mRNAs. The present application presents a number of cDNAs, called GENSET polynucleotides, isolated from full-length cDNA libraries obtained from the methods described in PCT publication WO 00/37491.

While many sequences derived from human chromosomes have practical applications, approaches based on the identification and characterization of those chromosomal sequences which encode a protein product are particularly relevant to diagnostic and therapeutic uses. Of the 50,000–100,000 protein coding genes, those genes encoding proteins which are secreted from the cell in which they are synthesized, as well as the secreted proteins themselves, are particularly valuable as potential therapeutic agents. Such proteins are often involved in cell to cell communication and may be responsible for producing a clinically relevant response in their target cells. In fact, several secretory proteins, including tissue plasminogen activator, G-CSF, GM-CSF, erythropoietin, human growth hormone, insulin, interferon-α, interferon-β, interferon-γ, and interleukin-2, are currently in clinical use. These proteins are used to treat a wide range of conditions, including acute myocardial infarction, acute ischemic stroke, anemia, diabetes, growth hormone deficiency, hepatitis, kidney carcinoma, chemotherapy induced neutropenia and multiple sclerosis. For these reasons, cDNAs encoding secreted proteins or fragments thereof represent a particularly valuable source of therapeutic agents. Thus, there is a need for the identification and characterization of secreted proteins and the nucleic acids encoding them.

In addition to being therapeutically useful themselves, secretory proteins include short peptides, called signal peptides, at their amino termini which direct their secretion. These signal peptides are encoded by the signal sequences located at the 5' ends of the coding sequences of genes encoding secreted proteins. Because these signal peptides will direct the extracellular secretion of any protein to which they are operably linked, the signal sequences may be exploited to direct the efficient secretion of any protein by operably linking the signal sequences to a gene encoding the protein for which secretion is desired. In addition, fragments of the signal peptides called membrane-translocating sequences, may also be used to direct the intracellular import of a peptide or protein of interest. This may prove beneficial in gene therapy strategies in which it is desired to deliver a particular gene product to cells other than the cells in which it is produced. Signal sequences encoding signal peptides also find application in simplifying protein purification techniques. In such applications, the extracellular secretion of the desired protein greatly facilitates purification by reducing the number of undesired proteins from which the desired protein must be selected. Thus, there exists a need to identify and characterize the 5' fragments of the genes for secretory proteins which encode signal peptides.

Sequences coding for human proteins may also find application as therapeutics or diagnostics. In particular, such sequences may be used to determine whether an individual is likely to express a detectable phenotype, such as a disease, as a consequence of a mutation in the coding sequence for a protein. In instances where the individual is at risk of suffering from a disease or other undesirable phenotype as a result of a mutation in such a coding sequence, the undesirable phenotype may be corrected by introducing a normal coding sequence using gene therapy. Alternatively, if the undesirable phenotype results from overexpression of the protein encoded by the coding sequence, expression of the protein may be reduced using antisense or triple helix based strategies.

The GENSET human polypeptides encoded by the coding sequences may also be used as therapeutics by administering them directly to an individual having a condition, such as a disease, resulting from a mutation in the sequence encoding the polypeptide. In such an instance, the condition can be cured or ameliorated by administering the polypeptide to the individual.

In addition, the human polypeptides or fragments thereof may be used to generate antibodies useful in determining the tissue type or species of origin of a biological sample. The antibodies may also be used to determine the subcellular localization of the human polypeptides or the cellular localization of polypeptides which have been fused to the human polypeptides. In addition, the antibodies may also be used in immunoaffinity chromatography techniques to isolate, purify, or enrich the human polypeptide or a target polypeptide which has been fused to the human polypeptide.

Public information on the number of human genes for which the promoters and upstream regulatory regions have been identified and characterized is quite limited. In part, this may be due to the difficulty of isolating such regulatory sequences. Upstream regulatory sequences such as transcription factor binding sites are typically too short to be utilized as probes for isolating promoters from human genomic libraries. Recently, some approaches have been developed to isolate human promoters. One of them consists of making a CpG island library (Cross et al., *Nature Genetics* 6: 236–244, 1994). The second consists of isolating human genomic DNA sequences containing SpeI binding sites by the use of SpeI binding protein. (Mortlock et al., *Genome Res.* 6:327–335, 1996). Both of these approaches have their limits due to a lack of specificity and of comprehensiveness. Thus, there exists a need to identify and systematically characterize the 5' fragments of the genes.

cDNAs including the 5' ends of their corresponding mRNA may be used to efficiently identify and isolate 5'UTRs and upstream regulatory regions which control the location, developmental stage, rate, and quantity of protein synthesis, as well as the stability of the mRNA (Theil et al., *BioFactors* 4:87–93, (1993). Once identified and characterized, these regulatory regions may be utilized in gene therapy or protein purification schemes to obtain the desired amount and locations of protein synthesis or to inhibit, reduce, or prevent the synthesis of undesirable gene products.

In addition, cDNAs containing the 5' ends of protein genes may include sequences useful as robes for chromosome mapping and the identification of individuals. Thus, there is a need to identify and characterize the sequences upstream of the 5' coding sequences of genes encoding proteins.

SUMMARY OF THE INVENTION

The present invention provides compositions containing a purified or isolated polynucleotide comprising, consisting of, or consisting essentially of a nucleotide sequence selected from the group consisting of: (a) the sequences of SEQ ID Nos: 1–241; (b) the sequences of clone inserts of the deposited clone pool; (c) the full coding sequences of SEQ ID Nos: 1–241; (d) the full coding sequences of the clone inserts of the deposited clone pool; (e) the sequences encoding one of the polypeptides of SEQ ID Nos: 242–482; (f) the sequences encoding one of the polypeptides encoded by the clone inserts of the deposited clone pool; (g) the genomic sequences coding for GENSET polypeptides; (h) the 5' transcriptional regulatory regions of GENSET genes; (i) the 3' transcriptional regulatory regions of GENSET genes; (j) the polynucleotides comprising the nucleotide sequence of any combination of (g)–(i); (k) the variant polynucleotides of any of the polynucleotides of (a)–(j); (l) the polynucleotides comprising a nucleotide sequence of (a)–(k), wherein the polynucleotide is single stranded, double stranded, or a portion is single stranded and a portion is double stranded;

(m) the polynucleotides comprising a nucleotide sequence complementary to any of the single stranded polynucleotides of (l). The invention further provides for fragments of the nucleic acid molecules of (a)–(m) described above.

The present invention also provides biologically active forms, variants, fragments and derivatives of the present proteins, where "biologically active" indicates that the form, variant, fragment, or derivative, has any detectable activity in any in vitro assay known in the art or described herein, or has any detectable function in vivo. In preferred embodiments, a determination of whether a particular polypeptide is biologically active will be made based on any of the specific assays or functional characteristics provided below for each of the proteins of this invention.

Therefore, one embodiment of the present invention is a composition containing a purified or isolated nucleic acid comprising a sequence selected from the group consisting of sequences of SEQ ID NOs: 1–241 and sequences of clone inserts of the deposited clone pool, sequences complementary thereto, allelic variants thereof, and degenerate variants thereof. In one aspect of this embodiment, the nucleic acid is recombinant.

Another embodiment of the present invention is a composition containing a purified or isolated nucleic acid comprising at least 8 consecutive nucleotides of a sequence selected from the group consisting of sequences of SEQ ID NOs: 1–241 and sequences of clone inserts of the deposited clone pool, sequences complementary thereto, allelic variants thereof, and degenerate variants thereof. In one aspect of this embodiment, the nucleic acid comprises at least 10, 12, 15, 18, 20, 25, 28, 30, 35, 40, 50, 75, 100, 150, 200, 300, 400, 500, 800, 1000, 1500, or 2000 consecutive nucleotides of said selected sequence, sequences complentary thereto, allelic variants thereof, and degenerate variants thereof. The nucleic acid may be a recombinant nucleic acid.

Another embodiment of the present invention is a composition comprising a vertebrate purified or isolated nucleic acid of at least 15, 18, 20, 23, 25, 28, 30, 35, 40, 50, 75, 100, 200, 300, 500, 1000 or 2000 nucleotides in length which hybridizes under stringent conditions to any polynucleotide of the invention, preferably a sequence selected from the group consisting of sequences of SEQ ID NOs: 1–241 and sequences of clone inserts of the deposited clone pool, sequences complementary thereto. In one aspect of this embodiment, the nucleic acid is recombinant.

Another embodiment of the present invention is a composition containing a purified or isolated nucleic acid comprising the full coding sequences of a sequence selected from the group consisting of sequences of SEQ ID NOs: 1–241 and sequences of clone inserts of the deposited clone pool, or an allelic variant thereof. In one aspect of this embodiment, the nucleic acid is recombinant.

A further embodiment of the present invention is a composition containing a purified or isolated nucleic acid comprising a contiguous span of a sequence selected from the group consisting of sequences of SEQ ID NOs: 1–31 and 33–143 and sequences of clone inserts encoding secreted proteins in the deposited clone pool, or an allelic variant thereof, wherein said contiguous span encodes a mature protein. In one aspect of this embodiment, the nucleic acid is recombinant. In another aspect of this embodiment, the nucleic acid is an expression vector wherein said contiguous span which encodes a mature protein is operably linked to a promoter.

Yet another embodiment of the present invention is a composition containing a purified or isolated nucleic acid comprising a contiguous span of a sequence selected from the group consisting of sequences of SEQ ID NOs: 1–31 and 33–143 and sequences of clone inserts encoding secreted proteins in the deposited clone pool, or an allelic variant thereof, wherein said contiguous span encodes a signal peptide. In one aspect of this embodiment, the nucleic acid is recombinant. In another aspect of this embodiment, the nucleic acid is an fusion vector wherein said contiguous span which encodes a signal peptide is operably linked to a second nucleic acid encoding an heterologous polypeptide.

Another embodiment of the present invention is a composition containing a purified or isolated nucleic acid encoding a polypeptide comprising a sequence selected from the group consisting of sequences of SEQ ID NOs: 1–241 and sequences of clone inserts of the deposited clone pool, or allelic variant thereof. In one aspect of this embodiment, the nucleic acid is recombinant.

Another embodiment of the present invention is a composition containing a purified or isolated nucleic acid encoding a polypeptide comprising the sequence of a mature protein included in a sequence selected from the group consisting of sequences of SEQ ID NOs: 1–31 and 33–143 and sequences of clone inserts encoding secreted proteins in the deposited clone pool, or allelic variant thereof. In one aspect of this embodiment, the nucleic acid is recombinant.

Another embodiment of the present invention is a composition containing a purified or isolated nucleic acid encoding a polypeptide comprising the sequence of a signal peptide included in a sequence selected from the group consisting of sequences of SEQ ID NOs: 1–31 and 33–143 and sequences of clone inserts encoding secreted proteins in the deposited clone pool, or allelic variant thereof. In another aspect it is present in a vector of the invention.

Further embodiments of the invention include compositions containing purified or isolated polynucleotides that comprise, a nucleotide sequence at least 70% identical, more preferably at least 75% identical, and still more preferably at least 80%, 85%, 90%, 95%, 96%, 97%, 98%, or 99% identical to any of the polynucleotides of the present invention. Methods of determining identity include those well known in the art and described herein. Such analyses can be performed using a full length polynucleotide sequence or using a subsequence of any length. For example, any two sequences can be compared over a region, in either protein or in both proteins, of any 10, 25, 50, 100, 250, 500, 1000, 2000 or more contiguous nucleotides. In addition, any two sequences can be identified as homologous even when they share sequence homology over a limited region of either polynucleotide, for example over a region of at least about 10, 25, 50, 100, 250, 500, 1000, or more contiguous nucleotides.

The invention further provides compositions containing a purified or isolated polypeptide comprising, consisting of, or consisting essentially of an amino acid sequence selected from the group consisting of: (a) the polypeptides of SEQ ID Nos: 242–482; (b) the polypeptides encoded by the clone inserts of the deposited clone pool; (c) the epitope-bearing fragments of the polypeptides of SEQ ID Nos: 242–482; (d) the epitope-bearing fragments of the polypeptides encoded by the clone inserts contained in the deposited clone pool; (e) the domains of the polypeptides of SEQ ID Nos: 242–482; (f) the domains of the polypeptides encoded by the clone inserts contained in the deposited clone pool; and (g) the allelic variant polypeptides of any of the polypeptides of (a)–(f). The invention further provides for fragments of the polypeptides of (a)–(g) above, such as those having biological activity or comprising biologically functional domain(s).

Yet another embodiment of the present invention is a composition containing a purified or isolated protein comprising a sequence selected from the group consisting of sequences of SEQ ID NOs: 242–482 and sequences of polypeptides encoded by clone inserts of the deposited clone pool, or allelic variant thereof.

Another embodiment of the present invention is a composition containing a purified or isolated polypeptide comprising at least 5, 6 or 8 consecutive amino acids of a sequence selected from the group consisting of sequences of SEQ ID NOs: 242–482 and sequences of polypeptides encoded by clone inserts of the deposited clone pool, or allellic variant thereof. In one aspect of this embodiment, the purified or isolated polypeptide comprises at least 10, 12, 15, 20, 25, 30, 35, 40, 50, 60, 75, 100, 150, 200, 250, 300, 350, 400, 450 or 500 consecutive amino acids of said selected sequence or allelic variant thereof.

Another embodiment of the present invention is a composition containing an isolated or purified polypeptide comprising a signal peptide of a sequence selected from the group consisting of sequences of SEQ ID NOs: 242–272 and 274–384 and sequences of polypeptides encoded by clone inserts of the deposited clone pool, or allellic variant thereof.

Yet another embodiment of the present invention is a composition containing an isolated or purified polypeptide comprising a mature protein of a sequence selected from the group consisting of sequences of SEQ ID NOs: 242–272 and 274–384 and sequences of polypeptides encoded by clone inserts of the deposited clone pool, or allellic variant thereof.

A further embodiment of the present invention are compositions containing polypeptide having an amino acid sequence with at least 70% similarity, and more preferably at least 75%, 80%, 85%, 90%, 95%, 96%, 97%, 98%, or 99% similarity to a polypeptide of the present invention, as well as polypeptides having an amino acid sequence at least 70% identical, more preferably at least 75% identical, and still more preferably 80%, 85%, 90%, 95%, 96%, 97%, 98%, or 99% identical to a polypeptide of the present invention. Such analyses can be performed using a full length polypeptide sequence or using a subsequence of any length. For example, any two sequences can be compared over a region, in either protein or in both proteins, of any 10, 25, 50, 100, 250, 500, 1000, 2000 or more contiguous amino acids. In addition, any two sequences can be identified as homologous even when they share sequence homology over a limited region of either protein, for example over a region of at least about 10, 25, 50, 100, 250, 500, 1000, or more contiguous amino acids. Further included in the invention are compositions comprising a purified or isolated nucleic acid molecule encoding such polypeptides. Methods for determining identity include those well known in the art and described herein.

The present invention also relates to compositions comprising recombinant vectors, which include the purified or isolated polynucleotides of the present invention, and to host cells recombinant for the polynucleotides of the present invention, as well as to methods of making such vectors and host cells. The present invention further relates to the use of these recombinant vectors and recombinant host cells in the production of GENSET polypeptides.

Consequently, another embodiment of the invention is a vector comprising any polynucleotide of the invention. In a preferred embodiment, the vector is an expression vector comprising a nucleic acid sequence encoding a polypeptide selected from the group consisting of sequences of SEQ ID NOs: 242–482 and sequences of polypeptides encoded by the clone inserts of the deposited clone pool, or allelic variant thereof, wherein said nucleic acid sequence is operably linked to a promoter. In another preferred embodiment, the vector is a secretion vector comprising a nucleic acid sequence encoding a signal peptide selected from the group consisting of signal peptides of sequences of SEQ ID NOs: 242–272 and 274–384 and sequences of secreted polypeptides encoded by the clone inserts of the deposited clone pool, or allelic variant thereof, wherein said nucleic acid sequence is operably linked to an heterologous protein such that said signal peptide will direct the secretion of said heterolgous protein.

A further embodiment of the present invention is a method of making a protein comprising a sequence selected from the group consisting of sequences of SEQ ID NOs: 242–482 and sequences of polypeptides encoded by clone inserts of the deposited clone pool, comprising the steps of:

a) obtaining a cDNA comprising a sequence selected from the group consisting of sequences of SEQ ID NOs: 1–241 and sequences of clone inserts of the deposited clone pool;

b) inserting said cDNA in an expression vector such that said cDNA is operably linked to a promoter; and c) introducing said expression vector into a host cell whereby the host cell produces the protein encoded by said cDNA.

In one aspect of this embodiment, the method further comprises the step of isolating said protein.

Another embodiment of the present invention is a protein obtainable by the method described in the preceding paragraph.

Another embodiment of the present invention is a method of making a protein comprising the amino acid sequence of the mature protein contained in a sequence selected from the group consisting of sequences of SEQ ID NOs: 242–272 and 274–384 and sequences of polypeptides encoded by clone inserts of the deposited clone pool, comprising the steps of a) obtaining a cDNA comprising a sequence selected from the group consisting of sequences of SEQ ID NOs: 1–31 and 33–143 and sequences of clone inserts of the deposited clone pool, wherein said cDNA encodes a mature protein;

b) inserting said cDNA in an expression vector such that said cDNA is operably linked to a promoter; and c) introducing said expression vector into a host cell whereby the host cell produces the mature protein encoded by said cDNA.

In one aspect of this embodiment, the method further comprises the step of isolating said protein.

Another embodiment of the present invention is a mature protein obtainable by the method described in the preceding paragraph.

Another embodiment of the present invention is a composition containing a host cell containing the purified or isolated nucleic acids comprising a sequence selected from the group consisting of sequences of SEQ ID NOs: 1–241 and sequences of clone inserts of the deposited clone pool or a sequence complementary thereto described herein.

Another embodiment of the present invention is a composition containing a host cell containing the purified or isolated nucleic acids comprising the full coding sequences of a sequence selected from the group consisting of sequences of SEQ ID NOs: 1–241 and sequences of clone inserts of the deposited clone pool.

Another embodiment of the present invention is a composition containing a host cell containing the purified or isolated nucleic acids comprising a contiguous span of a sequence selected from the group consisting of sequences of SEQ ID NOs: 1–31 and 33–143 and sequences of clone inserts of the deposited clone pool, wherein said contiguous span codes for a mature protein.

Another embodiment of the present invention is a composition containing a host cell containing the purified or isolated nucleic acids comprising a contiguous span of a sequence selected from the group consisting of sequences of SEQ ID NOs: 1–31 and 33–143 and sequences of clone inserts of the deposited clone pool, wherein said contiguous span codes for a signal peptide.

The invention further relates to other methods of making the polypeptides of the present invention.

The present invention further relates to transgenic plants or animals, wherein said transgenic plant or animal is transgenic for a polynucleotide of the present invention and expresses a polypeptide of the present invention.

The invention further relates to compositions comprising antibodies that specifically bind to the GENSET polypeptides of the present invention and fragments thereof as well as to methods for producing such antibodies and fragments thereof.

Therefore, another embodiment of the present invention is a composition containing a purified or isolated antibody capable of specifically binding to a protein comprising a sequence selected from the group consisting of sequences of SEQ ID NOs: 242–482 and sequences of polypeptides encoded by clone inserts of the deposited clone pool. In one aspect of this embodiment, the antibody is capable of binding to a polypeptide comprising at least 6 consecutive amino acids, at least 8 consecutive amino acids, or at least 10 consecutive amino acids of said selected sequence.

The invention also provides kits and methods of detecting GENSET gene expression and/or biological activity in a biological sample. One such method involves assaying for the expression of a GENSET polynucleotide in a biological sample using polymerase chain reaction (PCR) to amplify and detect GENSET polynucleotides or Southern and Northern blot hybridization to detect GENSET genomic DNA, cDNA or mRNA. Alternatively, a method of detecting GENSET gene expression in a test sample can be accomplished using a compound which binds to a GENSET polypeptide of the present invention or a portion of a GENSET polypeptide.

The present invention also relates to diagnostic methods of identifying individuals or non-human animals having elevated or reduced levels of GENSET products, which individuals are likely to benefit from therapies to suppress or enhance GENSET gene expression, respectively and to methods of identifying individuals or non-human animals at increased risk for developing, or present state of having, certain diseases/disorders associated with GENSET gene abnormal expression or biological activity.

The present invention also relates to kits and methods of screening compounds for their ability to modulate (e.g. increase or inhibit) the activity or expression of GENSET genes including compounds that interact with GENSET gene regulatory sequences and compounds that interact directly or indirectly with GENSET polypeptides. Uses of such compounds are also under the scope of the present invention.

The present invention also relates to pharmaceutical or physiologically acceptable compositions comprising, an active agent, the polypeptides, polynucleotides or antibodies of the present invention.

The present invention also relates to computer systems containing cDNA codes and polypeptides codes of sequences of the invention and to computer-related methods of comparing sequences, identifying homology or features using GENSET sequences of the invention.

In another aspect, the present invention provides an isolated polynucleotide, said polynucleotide comprising a nucleic acid sequence encoding i) a polypeptide comprising an amino acid sequence having at least about 80% identity to any one of the sequences shown as SEQ ID NOs:242–482 or any one of the sequences of polypeptides encoded by the clone inserts of the deposited clone pool; or a biologically active fragment of said polypeptide.

In one embodiment, the polypeptide comprises any one of the sequences shown as SEQ ID NOs:242–482 or any one of the sequences of the polypeptides encoded by the clone inserts of the deposited clone pool. In another embodiment, the polypeptide comprises a signal peptide. In another embodiment, the polypeptide is a mature protein. In another embodiment, the nucleic acid sequence has at least about 80% identity over at least about 100 contiguous nucleotides to any one of the sequences shown as SEQ ID NOs:1–241 or any one of the sequences of the clone inserts of the deposited clone pool. In another embodiment, the polynucleotide hybridizes under stringent conditions to a polynucleotide comprising any one of the sequences shown as SEQ ID NOs:1–241 or any one of the sequences of the clone inserts of the deposited clone pool. In another embodiment, the nucleic acid sequence comprises any one of the sequences shown as SEQ ID NOs:1–241 or any one the sequences of the clone inserts of the deposited clone pool. In another embodiment, the polynucleotide is operably linked to a promoter.

In another aspect, the present invention provides an expression vector comprising the polynucleotide operably linked to a promoter. In another aspect, the present invention provides a host cell recombinant for the polynucleotide. In another aspect, the present invention provides a non-human transgenic animal comprising the host cell.

In another aspect, the present invention provides a method of making a GENSET polypeptide, the method comprising a) providing a population of host cells comprising a herein-described polynucleotide and b) culturing the population of host cells under conditions conducive to the production of the polypeptide within said host cells.

In one embodiment, the method further comprises purifying the polypeptide from the population of host cells.

In another aspect, the present invention provides a method of making a GENSET polypeptide, the method comprising a) providing a population of cells comprising a herein-described polynucleotide; b) culturing the population of cells under conditions conducive to the production of the polypeptide within the cells; and c) purifying the polypeptide from the population of cells.

In another aspect, the present invention provides an isolated polynucleotide, the polynucleotide comprising a nucleic acid sequence having at least about 80% identity over at least about 100 contiguous nucleotides to any one of the sequences shown as SEQ ID NOs:1–241 or any one of the sequences of the clone inserts of the deposited clone pool.

In one embodiment, the polynucleotide hybridizes under stringent conditions to a polynucleotide comprising any one of the sequences shown as SEQ ID NOs:1–241 or any one of the sequences of the clone inserts of the deposited clone pool. In another embodiment, the polynucleotide comprises any one of the sequences shown as SEQ ID NOs:1–241 or any one of the sequences of the clone inserts of the deposited clone pool.

In another aspect, the present invention provides a biologically active polypeptide encoded by any of the herein-described polynucleotides.

In another aspect, the present invention provides an isolated polypeptide or biologically active fragment thereof, the polypeptide comprising an amino acid sequence having at least about 80% sequence identity to any one of the sequences shown as SEQ ID NOs:242–482 or any one of the sequences of polypeptides encoded by the clone inserts of the deposited clone pool.

In one embodiment, the polypeptide is selectively recognized by an antibody raised against an antigenic polypeptide, or an antigenic fragment thereof, said antigenic polypeptide comprising any one of the sequences shown as SEQ ID NOs:242–482 or any one of the sequences of polypeptides encoded by the clone inserts of the deposited clone pool. In another embodiment, the polypeptide comprises any one of the sequences shown as SEQ ID NOs:242–482 or any one of the sequences of polypeptides encoded by the clone inserts of the deposited clone pool. In another embodiment, the polypeptide comprises a signal peptide. In another embodiment, the polypeptide is a mature protein.

In another aspect, the present invention provides an antibody that specifically binds to any of ther herein-described polypeptides.

In another aspect, the present invention provides a method of determining whether a GENSET gene is expressed within a mammal, the method comprising the steps of: a) providing a biological sample from said mammal; b) contacting said biological sample with either of: i) a polynucleotide that hybridizes under stringent conditions to the polynucleotide of claim 1; or ii) a polypeptide that specifically binds to the polypeptide of claim 19; and c) detecting the presence or absence of hybridization between the polynucleotide and an RNA species within the sample, or the presence or absence of binding of the polypeptide to a protein within the sample; wherein a detection of the hybridization or of the binding indicates that the GENSET gene is expressed within the mammal.

In one embodiment, the polynucleotide is a primer, and the hybridization is detected by detecting the presence of an amplification product comprising the sequence of the primer. In another embodiment, the polypeptide is an antibody.

In another aspect, the present invention provides a method of determining whether a mammal has an elevated or reduced level of GENSET gene expression, the method comprising the steps of: a) providing a biological sample from the mammal; and b) comparing the amount of any of the herein-described polypeptides, or of an RNA species encoding the polypeptide, within the biological sample with a level detected in or expected from a control sample; wherein an increased amount of the polypeptide or the RNA species within the biological sample compared to the level detected in or expected from the control sample indicates that the mammal has an elevated level of the GENSET gene expression, and wherein a decreased amount of the polypeptide or the RNA species within the biological sample compared to the level detected in or expected from the control sample indicates that the mammal has a reduced level of the GENSET gene expression.

In another aspect, the present invention provides a method of identifying a candidate modulator of a GENSET polypeptide, the method comprising: a) contacting any of the herein-described polypeptides with a test compound; and b) determining whether the compound specifically binds to the polypeptide; wherein a detection that the compound specifically binds to the polypeptide indicates that the compound is a candidate modulator of the GENSET polypeptide.

BRIEF DESCRIPTION OF TABLES

Figure 1:
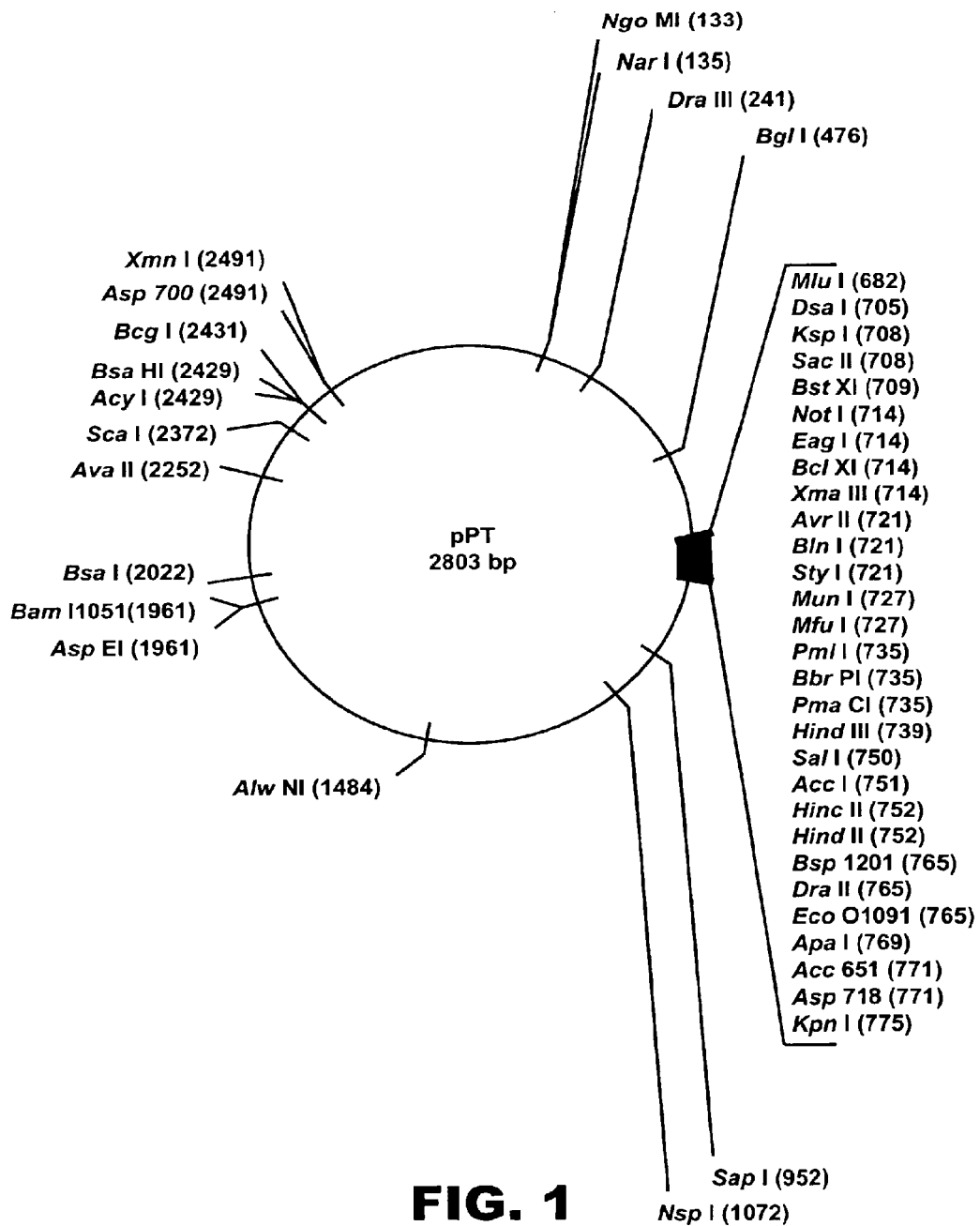
FIG. 1 is a map of the expression vector pPT

Table I provides the applicant's internal designation number assigned to each sequence identification number and indicates whether the sequence is a nucleic acid sequence or a polypeptide sequence, and in which vector the cDNA was cloned.

Table II provides structural features for each cDNA of SEQ ID Nos: 1–241 i.e., the locations of the full coding sequences, the signal peptides, the mature polypeptides, the polyA signal and the polyA site.

Table III lists variants for cDNAs of the present invention.

Table IV provides the positions of fragments which are preferably excluded from the present invention.

Tables Va and b provides the positions of fragments which are preferably excluded or included in the present invention. Table IV and Tables Va, and Table Vb provide for the inclusion and exclusion of polynucleotides independently from each other in addition to those described elsewhere in the specification and is therefore, not meant as limiting description.

Table VI lists known biologically structural and functional domains for the polypeptides of the present invention.

Table VII lists antigenic peaks of predicted antigenic epitopes for polypeptides of the present invention.

Table VIII lists the putative chromosomal location of the polynucleotides of the present invention.

Table IX list the Genset's cDNA libraries of tissues and cell types examined that express the polynucleotides of the present invention.

Table X relates to the bias in spatial distribution of the polynucleotide sequences of the present invention.

Table XI lists predicted subcellular localization for cDNAs of the present invention.

Table XII gives the correspondence between the polynucleotides of the U.S. priority applications, namely the U.S. Provisional Patent Applications Ser. Nos. 60/169,629 and 60/187, (column entitled "Seq Id No in priority applications") and the polynucleotides of the present application (column entitled "Seq Id No in present application").

BRIEF DESCRIPTION OF SEQUENCE LISTING

SEQ ID Nos: 1–31 and 33–143 are the nucleotide sequences of cDNAs encoding a potentially secreted protein. The locations of the ORFs and sequences encoding signal peptides are listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein. When appropriate, the locations of the first and last nucleotides of the coding sequences, eventually the locations of the first and last nucleotides of the polyA and the locations of the first and last nucleotides of the polyA sites are indicated.

SEQ ID Nos. 32 and 144–241 are the nucleotide sequences of cDNAs in which no sequence encoding a signal peptide has been identified to date. However, it remains possible that subsequent analysis will identify a sequence encoding a signal peptide in these nucleic acids. The locations of the ORFs are listed in the accompanying Sequence Listing. When appropriate, the locations of the first and last nucleotides of the coding sequences, eventually the locations of the first and last nucleotides of the polyA and the locations of the first and last nucleotides of the polyA sites are indicated.

SEQ ID Nos: 242–272 and 274–384 are the amino acid sequences of polypeptides which contain a signal peptide. These polypeptides are encoded by the cDNAs of SEQ ID Nos: 1–31 and 33–143 respectively. The location of the signal peptide is listed in the accompanying Sequence Listing.

SEQ ID Nos: 273 and 385–482 are the amino acid sequences of polypeptides in which no signal peptide has been identified to date. However, it remains possible that subsequent analysis will identify a signal peptide in these polypeptides. These polypeptides are encoded by the nucleic acids of SEQ ID Nos: 32 and 144–241 respectively.

In accordance with the regulations relating to Sequence Listings, the following codes have been used in the Sequence Listing to describes nucleotide sequences. The code "r" in the sequences indicates that the nucleotide may be a guanine or an adenine. The code "Y" in the sequences indicates that the nucleotide may be a thymine or a cytosine. The code "m" in the sequences indicates that the nucleotide may be an adenine or a cytosine. The code "k" in the sequences indicates that the nucleotide may be a guanine or a thymine. The code "s" in the sequences indicates that the nucleotide may be a guanine or a cytosine. The code "w" in the sequences indicates that the nucleotide may be an adenine or a thymine. In addition, all instances of the symbol "n" in the nucleic acid sequences mean that the nucleotide can be adenine, guanine, cytosine or thymine.

In some instances, the polypeptide sequences in the Sequence Listing contain the symbol "Xaa." These "Xaa" symbols indicate either (1) a residue which cannot be identified because of nucleotide sequence ambiguity or (2) a stop codon in the determined sequence where applicants believe one should not exist (if the sequence were determined more accurately). In some instances, several possible identities of the unknown amino acids may be suggested by the genetic code.

In the case of secreted proteins, it should be noted that, in accordance with the regulations governing Sequence Listings, in the appended Sequence Listing, the encoded protein (i.e. the protein containing the signal peptide and the mature protein or part thereof) extends from an amino acid residue having a negative number through a positively numbered amino acid residue. Thus, the first amino acid of the mature protein resulting from cleavage of the signal peptide is designated as amino acid number 1, and the first amino acid of the signal peptide is designated with the appropriate negative number. However, in the present application, positions on amino acid sequences are always given on the full length polypeptide, the first amino acid of the signal peptide being designated as amino acid number 1.

DETAILED DESCRIPTION

Definitions

Before describing the invention in greater detail, the following definitions are set forth to illustrate and define the meaning and scope of the terms used to describe the invention herein.

The terms "GENSET gene", when used herein, encompasses genomic, mRNA and cDNA sequences encoding the GENSET protein, including the 5' and 3' untranslated regions of said sequences.

As used herein, a "secreted" protein is one which, when expressed in a suitable host cell, is transported across or through a membrane, including transport as a result of signal peptides in its amino acid sequence. "Secreted" proteins include without limitation proteins secreted wholly (e.g. soluble proteins), or partially (e.g. receptors) from the cell in which they are expressed. "Secreted" proteins also include without limitation proteins which are transported across the membrane of the endoplasmic reticulum. As used herein, a "mature protein" is the polypeptide fragment generated after the cleavage of the signal peptide.

The term "full coding sequence" or open reading frame (ORF) of a GENSET gene, when used herein, refers to the complete coding sequence of said gene. In the case of a secreted protein, the full coding sequence comprises the coding sequence for the signal peptide and the coding sequence for the mature polypeptide. Accordingly, the term "full-length polypeptide" refers to the complete polypeptide encoded by said GENSET gene and in the case of a secreted protein it comprises both the signal peptide and the mature polypeptide. The positions of the full length polypeptides and, in the case of secreted proteins, of signal peptides and mature polypeptides are given in the appended sequence listing.

The term "GENSET biological activity" is intended for polypeptides exhibiting an activity similar, but not necessarily identical, to an activity of the GENSET polypeptide of the invention. The GENSET biological activity of a given polypeptide may be assessed using a suitable biological assay well known to those skilled in the art such as the one(s) described herein. In contrast, the term "biological activity" refers to any activity that a polypeptide of the invention may have.

The term "corresponding mRNA" refers to the mRNA which was the template for the cDNA synthesis which produced a cDNA of the present invention.

The term "corresponding genomic DNA" refers to the genomic DNA which encodes mRNA which includes the sequence of one of the strands of the cDNA in which thymidine residues in the sequence of the cDNA are replaced by uracil residues in the mRNA.

The term "deposited clone pool" is used herein to refer to the pool of clones entitled GENSET.071PRF deposited in ATCC with the accession number PTA-1218 on Jan. 21, 2000.

The term "heterologous", when used herein, is intended to designate any polynucleotide or polypeptide other than the GENSET polynucleotide or polypeptide respectively.

The term "isolated" requires that the material be removed from its original environment (e. g., the natural environment if it is naturally occurring). For example, a naturally-occurring polynucleotide or polypeptide present in a living animal is not isolated, but the same polynucleotide or DNA or polypeptide, separated from some or all of the coexisting materials in the natural system, is isolated. Such polynucleotide could be part of a vector and/or such polynucleotide or polypeptide could be part of a composition, and still be isolated in that the vector or composition is not part of its natural environment. For example, a naturally-occurring polynucleotide present in a living animal is not isolated, but the same polynucleotide, separated from some or all of the coexisting materials in the natural system, is isolated. Specifically excluded from the definition of "isolated" are: naturally-occurring chromosomes (such as chromosome spreads), artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein a specified polynucleotide makes up less than 5% of the number of nucleic acid inserts in the vector molecules. Further specifically excluded are whole cell genomic DNA or whole cell RNA preparations (including said whole cell preparations which are mechanically sheared or enzymatically digested). Further specifically excluded are the above whole cell preparations as either an in vitro preparation or as a heterogeneous mixture separated by electrophoresis (including blot transfers of the same) wherein the polynucleotide of the invention has not further been separated from the heterologous polynucleotides in the electrophoresis medium (e.g., further separating by excising a single band from a heterogeneous band population in an agarose gel or nylon blot).

The term "purified" does not require absolute purity; rather, it is intended as a relative definition. Purification of starting material or natural material to at least one order of magnitude, preferably two or three orders, and more preferably four or five orders of magnitude is expressly contemplated. As an example, purification from 0.1% concentration to 10% concentration is two orders of magnitude. To illustrate, individual cDNA clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message.

The term "purified" is further used herein to describe a polypeptide or polynucleotide of the invention which has been separated from other compounds including, but not limited to, polypeptides or polynucleotides, carbohydrates, lipids, etc. The term "purified" may be used to specify the separation of monomeric polypeptides of the invention from oligomeric forms such as homo- or hetero-dimers, trimers, etc. The term "purified" may also be used to specify the separation of covalently closed polynucleotides from linear polynucleotides. A polynucleotide is substantially pure when at least about 50%, preferably 60 to 75% of a sample exhibits a single polynucleotide sequence and conformation (linear versus covalently close). A substantially pure polypeptide or polynucleotide typically comprises about 50%, preferably 60 to 90% weight/weight of a polypeptide or polynucleotide sample, respectively, more usually about 95%, and preferably is over about 99% pure. Polypeptide and polynucleotide purity, or homogeneity, is indicated by a number of means well known in the art, such as agarose or polyacrylamide gel electrophoresis of a sample, followed by visualizing a single band upon staining the gel. For certain purposes higher resolution can be provided by using HPLC or other means well known in the art. As an alternative embodiment, purification of the polypeptides and polynucleotides of the present invention may be expressed as "at least" a percent purity relative to heterologous polypeptides and polynucleotides (DNA, RNA or both). As a preferred embodiment, the polypeptides and polynucleotides of the present invention are at least; 10%, 20%, 30%, 40%, 50%, 60%, 70%, 80%, 90%, 95%, 96%, 96%, 98relative to heterologous polypeptides and polynucleotides, respectively. As a further preferred embodiment the polypeptides and polynucleotides have a purity ranging from any number, to the thousandth position, between 90% and 100% (e.g., a polypeptide or polynucleotide at least 99.995% pure) relative to either heterologous polypeptides or polynucleotides, respectively, or as a weight/weight ratio relative to all compounds and molecules other than those existing in the carrier. Each number representing a percent purity, to the thousandth position, may be claimed as individual species of purity.

As used interchangeably herein, the terms "nucleic acid molecule(s)", "oligonucleotide(s)", and "polynucleotide(s)" include RNA or DNA (either single or double stranded, coding, complementary or antisense), or RNA/DNA hybrid sequences of more than one nucleotide in either single chain or duplex form (although each of the above species may be particularly specified). The term "nucleotide" is used herein as an adjective to describe molecules comprising RNA, DNA, or RNA/DNA hybrid sequences of any length in single-stranded or duplex form. More precisely, the expression "nucleotide sequence" encompasses the nucleic material itself and is thus not restricted to the sequence information (i.e. the succession of letters chosen among the four base letters) that biochemically characterizes a specific DNA or RNA molecule. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. The term "nucleotide" is also used herein to encompass "modified nucleotides" which comprise at least one modifications such as (a) an alternative linking group, (b) an analogous form of purine, (c) an analogous form of pyrimidine, or (d) an analogous sugar. For examples of analogous linking groups, purine, pyrimidines, and sugars see for example PCT publication No. WO 95/04064, which disclosure is hereby incorporated by reference in its entirety. Preferred modifications of the present invention include, but are not limited to, 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v) ybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid, 5-methyl-2-thiouracil, 3-(3-amino-3-N-2-carboxypropyl)uracil, and 2,6-diaminopurine. The polynucleotide sequences of the invention may be prepared by any known method, including synthetic, recombinant, ex vivo generation, or a combination thereof, as well as utilizing any purification methods known in the art. Methylenemethylimino linked oligonucleosides as well as mixed backbone compounds having, may be prepared as described in U.S. Pat. Nos. 5,378,825; 5,386,023; 5,489,677; 5,602,240; and 5,610,289, which disclosures are hereby incorporated by reference in their entireties. Formacetal and thioformacetal linked oligonucleosides may be prepared as described in U.S. Pat. Nos. 5,264,562 and 5,264,564, which disclosures are hereby incorporated by reference in their entireties. Ethylene oxide linked oligonucleosides may be prepared as described in U.S. Pat. No. 5,223,618, which disclosure is hereby incorporated by reference in its entirety. Phosphinate oligonucleotides may be prepared as described in U.S. Pat. No. 5,508,270, which disclosure is hereby incorporated by reference in its entirety. Alkyl phosphonate oligonucleotides may be prepared as described in U.S. Pat. No. 4,469,863, which disclosure is hereby incorporated by reference in its entirety. 3'-Deoxy-3'-methylene phosphonate oligonucleotides may be prepared as described in U.S. Pat. Nos. 5,610,289 or 5,625,050 which disclosures are hereby incorporated by reference in their entireties. Phosphoramidite oligonucleotides may be prepared as described in U.S. Pat. Nos. 5,256,775 or 5,366,878 which disclosures are hereby incorporated by reference in their entireties. Alkylphosphonothioate oligonucleotides may be prepared as described in published PCT applications WO 94/17093 and WO 94/02499 which disclosures are hereby incorporated by reference in their entireties. 3'-Deoxy-3'-amino phosphoramidate oligonucleotides may be prepared as described in U.S. Pat. No. 5,476,925, which disclosure is hereby incorporated by reference in its entirety. Phosphotriester oligonucleotides may be prepared as described in U.S. Pat. No. 5,023,243, which disclosure is hereby incorporated by reference in its entirety. Borano phosphate oligonucleotides may be prepared as described in U.S. Pat. Nos. 5,130,302 and 5,177,198 which disclosures are hereby incorporated by reference in their entireties.

The term "upstream" is used herein to refer to a location which is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, 1995, which disclosure is hereby incorporated by reference in its entirety).

The terms "complementary" or "complement thereof" are used herein to refer to the sequences of polynucleotides which is capable of forming Watson & Crick base pairing with another specified polynucleotide throughout the entirety of the complementary region. For the purpose of the present invention, a first polynucleotide is deemed to be complementary to a second polynucleotide when each base in the first polynucleotide is paired with its complementary base. Complementary bases are, generally, A and T (or A and U), or C and G. "Complement" is used herein as a synonym from "complementary polynucleotide", "complementary nucleic acid" and "complementary nucleotide sequence". These terms are applied to pairs of polynucleotides based solely upon their sequences and not any particular set of conditions under which the two polynucleotides would actually bind. Unless otherwise stated, all complementary polynucleotides are fully complementary on the whole length of the considered polynucleotide.

The terms "polypeptide" and "protein", used interchangeably herein, refer to a polymer of amino acids without regard to the length of the polymer; thus, peptides, oligopeptides, and proteins are included within the definition of polypeptide. This term also does not specify or exclude chemical or post-expression modifications of the polypeptides of the invention, although chemical or post-expression modifications of these polypeptides may be included excluded as specific embodiments. Therefore, for example, modifications to polypeptides that include the covalent attachment of glycosyl groups, acetyl groups, phosphate groups, lipid groups and the like are expressly encompassed by the term polypeptide. Further, polypeptides with these modifications may be specified as individual species to be included or excluded from the present invention. The natural or other chemical modifications, such as those listed in examples above can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance Creighton (1993); Seifter et al., (1990); Rattan et al., (1992)). Also included within the definition are polypeptides which contain one or more analogs of an amino acid (including, for example, non-naturally occurring amino acids, amino acids which only occur naturally in an unrelated biological system, modified amino acids from mammalian systems, etc.), polypeptides with substituted linkages, as well as other modifications known in the art, both naturally occurring and non-naturally occurring.

As used herein, the terms "recombinant polynucleotide" and "polynucleotide construct" are used interchangeably to refer to linear or circular, purified or isolated polynucleotides that have been artificially designed and which comprise at least two nucleotide sequences that are not found as contiguous nucleotide sequences in their initial natural environment. In particular, this terms mean that the polynucleotide or cDNA is adjacent to "backbone" nucleic acid to which it is not adjacent in its natural environment. Additionally, to be "enriched" the cDNAs will represent 5% or more of the number of nucleic acid inserts in a population of nucleic acid backbone molecules. Backbone molecules according to the present invention include nucleic acids such as expression vectors, self-replicating nucleic acids, viruses, integrating nucleic acids, and other vectors or nucleic acids used to maintain or manipulate a nucleic acid insert of interest. Preferably, the enriched cDNAs represent 15% or more of the number of nucleic acid inserts in the population of recombinant backbone molecules. More preferably, the enriched cDNAs represent 50% or more of the number of nucleic acid inserts in the population of recombinant backbone molecules. In a highly preferred embodiment, the enriched cDNAs represent 90% or more (including any number between 90 and 100%, to the thousandth position, e.g., 99.5%) # of the number of nucleic acid inserts in the population of recombinant backbone molecules.

The term "recombinant polypeptide" is used herein to refer to polypeptides that have been artificially designed and which comprise at least two polypeptide sequences that are not found as contiguous polypeptide sequences in their initial natural environment, or to refer to polypeptides which have been expressed from a recombinant polynucleotide.

As used herein, the term "operably linked" refers to a linkage of polynucleotide elements in a functional relationship. A sequence which is "operably linked" to a regulatory sequence such as a promoter means that said regulatory element is in the correct location and orientation in relation to the nucleic acid to control RNA polymerase initiation and expression of the nucleic acid of interest. For instance, a promoter or enhancer is operably linked to a coding sequence if it affects the transcription of the coding sequence.

As used herein, the term "non-human animal" refers to any non-human animal, including insects, birds, rodents and more usually mammals. Preferred non-human animals include: primates; farm animals such as swine, goats, sheep, donkeys, cattle, horses, chickens, rabbits; and rodents, preferably rats or mice. As used herein, the term "animal" is used to refer to any species in the animal kingdom, preferably vertebrates, including birds and fish, and more preferable a mammal. Both the terms "animal" and "mammal" expressly embrace human subjects unless preceded with the term "non-human".

The term "domain" refers to an amino acid fragment with specific biological properties. This term encompasses all known structural and linear biological motifs. Examples of such motifs include but are not limited to leucine zippers, helix-turn-helix motifs, glycosylation sites, ubiquitination sites, alpha helices, and beta sheets, signal peptides which direct the secretion of proteins, sites for post-translational modification, enzymatic active sites, substrate binding sites, and enzymatic cleavage sites.

Although they have distinct meanings, the terms "comprising", "consisting of" and "consisting essentially of" may be interchanged for one another throughout the instant application". The term "having" has the same meaning as "comprising" and may be replaced with either the term "consisting of" or "consisting essentially of".

An "amplification product" refers to a product of any amplification reaction, e.g. PCR, RT-PCR, LCR, etc.

A "modulator" of a protein or other compound refers to any agent that has a functional effect on the protein, including physical binding to the protein, alterations of the quantity or quality of expression of the protein, altering any measurable or detectable activity, property, or behavior of the protein, or in any way interacts with the protein or compound.

"A test compound" can be any molecule that is evaluated for its ability to modulate a protein or other compound.

Unless otherwise specified in the application, nucleotides and amino acids of polynucleotides and polypeptides respectively of the present invention are contiguous and not interrupted by heterologous sequences.

Identity Between Nucleic Acids or Polypeptides

The terms "percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to, TBLASTN, BLASTP, FASTA, TFASTA, CLUSTALW, FASTDB (Pearson and Lipman, 1988; Altschul et al., 1990; Thompson et al., 1994; Higgins et al., 1996; Altschul et al., 1990; Altschul et al., 1993; Brutlag et al, 1990), the disclosures of which are incorporated by reference in their entireties.

In a particularly preferred embodiment, protein and nucleic acid sequence homologies are evaluated using the Basic Local Alignment Search Tool ("BLAST") which is well known in the art (see, e.g., Karlin and Altschul, 1990; Altschul et al., 1990, 1993, 1997), the disclosures of which are incorporated by reference in their entireties. In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992; Henikoff and Henikoff, 1993), the disclosures of which are incorporated by reference in their entireties. Less preferably, the PAM or PAM250 matrices may also be used (see, e.g., Schwartz and Dayhoff, eds., 1978), the disclosure of which is incorporated by reference in its entirety. The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990), the disclosure of which is incorporated by reference in its entirety. The BLAST programs may be used with the default parameters or with modified parameters provided by the user.

Another preferred method for determining the best overall match between a query nucleotide sequence (a sequence of the present invention) and a subject sequence, also referred to as a global sequence alignment, can be determined using the FASTDB computer program based on the algorithm of Brutlag et al. (1990), the disclosure of which is incorporated by reference in its entirety. In a sequence alignment the query and subject sequences are both DNA sequences. An RNA sequence can be compared by first converting U's to T's. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is 35 shorter. If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3'ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using 10, the specified parameters, to arrive at a final percent identity score. This corrected score is what is used for the purposes of the present invention. Only nucleotides outside the 5' and 3' nucleotides of the subject sequence, as displayed by the FASTDB alignment, which are not matched/aligned with the query sequence, are calculated for the purposes of manually adjusting the percent identity score. For example, a 90 nucleotide subject sequence is aligned to a 100 nucleotide query sequence to determine percent identity. The deletions occur at the 5' end of the subject sequence and therefore, the FASTDB alignment does not show a matched/alignment of the first 10 nucleotides at 5' end. The 10 unpaired nucleotides represent 10% of the sequence (number of nucleotides at the 5' and 3' ends not matched/total number of nucleotides in the query sequence) so 10% is subtracted from the percent identity score calculated by the FASTDB program. If the remaining 90 nucleotides were perfectly matched the final percent identity would be 90%. In another example, a 90 nucleotide subject sequence is compared with a 100 nucleotide query sequence. This time the deletions are internal deletions so that there are no nucleotides on the 5' or 3' of the subject sequence which are not matched/aligned with the query. In this case the percent identity calculated by FASTDB is not manually corrected. Once again, only nucleotides 5' and 3' of the subject sequence which are not matched/aligned with the query sequence are manually corrected. No other manual corrections are made for the purposes of the present invention.

Another preferred method for determining the best overall match between a query amino acid sequence (a sequence of the present invention) and a subject sequence, also referred to as a global sequence alignment, can be determined using the FASTDB computer program based on the algorithm of Brutlag et al. (1990). In a sequence alignment the query and subject sequences are both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group25 Length=0, Cutoff Score=1, Window Size=sequence length, Gap Penalty=5, Gap Size Penalty=0.05, Window Size=500 or the length of the subject amino acid sequence, whichever is shorter. If the subject sequence is shorter than the query sequence due to N-or C-terminal deletions, not because of internal deletions, the results, in percent identity, must be manually corrected. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query amino acid residues outside the farthest N- and C-terminal residues of the subject sequence. For example, a 90 amino acid residue subject sequence is aligned with a 100-residue query sequence to determine percent identity. The deletion occurs at the N-terminus of the subject sequence and therefore, the FASTDB alignment does not match/align with the first residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100-residue query sequence. This time the deletions are internal so there are no residues at the N- or C-termini of the subject sequence, which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected. No other manual corrections are made for the purposes of the present invention.

The term "percentage of sequence similarity" refers to comparisons between polypeptide sequences and is determined by comparing two optimally aligned sequences over a comparison window, wherein the portion of the polypeptide sequence in the comparison window may comprise additions or deletions (i.e., gaps) as compared to the reference sequence (which does not comprise additions or deletions) for optimal alignment of the two sequences. The percentage is calculated by determining the number of positions at which an identical or equivalent amino acid residue occurs in both sequences to yield the number of matched positions, dividing the number of matched positions by the total number of positions in the window of comparison and multiplying the result by 100 to yield the percentage of sequence similarity. Similarity is evaluated using any of the variety of sequence comparison algorithms and programs known in the art, including those described above in this section. Equivalent amino acid residues are defined herein in the "Mutated polypeptides" section.

Polynucleotides of the Invention

The present invention concerns GENSET genomic and cDNA sequences. The present invention encompasses GENSET genes, polynucleotides comprising GENSET genomic and cDNA sequences, as well as fragments and variants thereof. These polynucleotides may be purified, isolated, or recombinant.

Also encompassed by the present invention are allelic variants, orthologs, splice variants, and/or species homologues of the GENSET genes. Procedures known in the art can be used to obtain full-length genes and cDNAs, allelic variants, splice variants, full-length coding portions, orthologs, and/or species homologues of genes and cDNAs corresponding to a nucleotide sequence selected from the group consisting of sequences of SEQ ID Nos: 1–241 and sequences of clone inserts of the deposited clone pool, using information from the sequences disclosed herein or the clone pool deposited with the ATCC. For example, allelic variants, orthologs and/or species homologues may be isolated and identified by making suitable probes or primers from the sequences provided herein and screening a suitable nucleic acid source for allelic variants and/or the desired homologue using any technique known to those skilled in the art including those described into the section entitled "To find similar sequences".

In a specific embodiment, the polynucleotides of the invention are at least 15, 30, 50, 100, 125, 500, or 1000 continuous nucleotides. In another embodiment, the polynucleotides are less than or equal to 300 kb, 200 kb, 100 kb, 50 kb, 10 kb, 7.5 kb, 5 kb, 2.5 kb, 2 kb, 1.5 kb, or 1 kb in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e., 5' or 3' to the gene of interest in the genome). In other embodiments, the polynucleotides of the invention do not contain the coding sequence of more than 1000, 500, 250, 100, 75, 50, 25, 20, 15, 10, 5, 4, 3, 2, or 1 naturally occurring genomic flanking gene(s).

Deposited Clone Pool of the Invention

Expression of GENSET genes has been shown to lead to the production of at least one mRNA species per GENSET gene, which cDNA sequence is set forth in the appended sequence listing as SEQ ID Nos: 1–241. The cDNAs (SEQ ID Nos: 1–241) corresponding to these GENSET mRNA species were cloned in the vector pBluescriptII SK⁻ (Stratagene) or one of its derivative called pPT (see FIG. 1).

Cells containing the cloned cDNAs of the present invention are maintained in permanent deposit by the inventors at Genset, S.A., 24 Rue Royale, 75008 Paris, France. Table I provides the applicant's internal designation number (column entitled "Internal designation") assigned to each sequence identification number of SEQ ID Nos: 1–482 (column entitled "Seq Id No") and indicates whether the sequence is a nucleic acid sequence or a polypeptide sequence (column entitled "Type"), and in which vector the cDNA was cloned (column entitled "Vector").

Each cDNA can be removed from the Bluescript vector in which it was inserted by performing a NotI Pst I double digestion to produce the appropriate fragment for each clone provided the cDNA sequence of interest does not contain this restriction site within its sequence. The preferable sites for cDNA removal for those clones inserted into pPT are MunI and HindIII, the sites used for cloning provided the cDNA sequence of interest does not contain this restriction site within its sequence. Alternatively, other restriction enzymes of the multicloning site of the vector may be used to recover the desired insert as indicated by the manufacturer or in FIG. 1.

Pool of cells containing the cDNAs of the invention, from which the cells containing a particular polynucleotide is obtainable, were also deposited with the American Tissue Culture Collection (ATCC), 10801 University Boulevard, Manassas, Va. 20110–2209, United States. Each cDNA clone has been transfected into separate bacterial cells (*E-coli*) for these composite deposits. In particular, cells containing the sequences of SEQ ID Nos: 1–241 were deposited on Jan. 21, 2000 in the pool having ATCC Accession No. PTA-1218 and designated GENSET.071PRF.

Bacterial cells containing a particular clone can be obtained from the composite deposit as follows:

An oligonucleotide probe or probes should be designed to the sequence that is known for that particular clone. This sequence can be derived from the sequences provided herein, or from a combination of those sequences. The design of the oligonucleotide probe should preferably follow these parameters:

(a) It should be designed to an area of the sequence which has the fewest ambiguous bases ("N's"), if any;

(b) Preferably, the probe is designed to have a Tm of approximately 80 degree Celsius (assuming 2 degrees for each A or T and 4 degrees for each G or C). However, probes having melting temperatures between 40 degree Celsius and 80 degree Celsius may also be used provided that specificity is not lost.

The oligonucleotide should preferably be labeled with gamma[$^{32}$P]ATP (specific activity 6000 Ci/mmole) and T4 polynucleotide kinase using commonly employed techniques for labeling oligonucleotides. Other labeling techniques can also be used. Unincorporated label should preferably be removed by gel filtration chromatography or other established methods. The amount of radioactivity incorporated into the probe should be quantified by measurement in a scintillation counter. Preferably, specific activity of the resulting probe should be approximately $4 \times 10^6$ dpm/pmole.

The bacterial culture containing the pool of full-length clones should preferably be thawed and 100 ul of the stock used to inoculate a sterile culture flask containing 25 ml of sterile L-broth containing ampicillin at 100 ug/ml. The culture should preferably be grown to saturation at 37 degree Celsius, and the saturated culture should preferably be diluted in fresh L-broth. Aliquots of these dilutions should preferably be plated to determine the dilution and volume which will yield approximately 5000 distinct and well-separated colonies on solid bacteriological media containing L-broth containing ampicillin at 100 ug/ml and agar at 1.5% in a 150 mm petri dish when grown overnight at 37 degree Celsius. Other known methods of obtaining distinct, well-separated colonies can also be employed.

Standard colony hybridization procedures should then be used to transfer the colonies to nitrocellulose filters and lyse, denature and bake them.

The filter is then preferably incubated at 65 degree Celsius for 1 hour with gentle agitation in 6×SSC (20× stock is 175.3 g NaCl/liter, 88.2 g Na citrate/liter, adjusted to pH 7.0 with NaOH) containing 0.5% SDS, 100 pg/ml of yeast RNA, and 10 mM EDTA (approximately 10 ml per 150 mm filter). Preferably, the probe is then added to the hybridization mix at a concentration greater than or equal to $1 \times 10^6$ dpm/ml. The filter is then preferably incubated at 65 degree Celsius with gentle agitation overnight. The filter is then preferably washed in 500 ml of 2×SSC/0.1% SDS at room temperature with gentle shaking for 15 minutes. A third wash with 0.1×SSC/0.5% SDS at 65 degree Celsius for 30 minutes to 1 hour is optional. The filter is then preferably dried and subjected to autoradiography for sufficient time to visualize the positives on the X-ray film. Other known hybridization methods can also be employed.

The positive colonies are picked, grown in culture, and plasmid DNA isolated using standard procedures. The clones can then be verified by restriction analysis, hybridization analysis, or DNA sequencing. The plasmid DNA obtained using these procedures may then be manipulated using standard cloning techniques familiar to those skilled in the art.

Alternatively, to recover cDNA inserts from the pool of bacteria, a PCR can be performed on plasmid DNA isolated using standard procedures and primers designed at both ends of the cDNA insertion, including primers designed in the multicloning site of the vector. For example, a PCR reaction may be conducted using universal primers designed by the plasmid provider or using primers which are specific to the cDNA of interest. In the case of Bluescript SK(−), a PCR reaction may be conducted using a primer having the sequence GGAAACAGCTATGACCA and a primer having the sequence GTAAAACGACGGCCAGT. This will produce a DNA fragment including a piece of the multiple cloning site and the cDNA insert. If a specific cDNA of interest is to be recovered, primers may be designed in order to be specific for the 5' end and the 3' end of this cDNA using sequence information available from the appended sequence listing. The PCR product which corresponds to the cDNA of interest can then be manipulated using standard cloning techniques familiar to those skilled in the art.

Therefore, an object of the invention is an isolated, purified, or recombinant polynucleotide comprising a nucleotide sequence selected from the group consisting of cDNA inserts of the deposited clone pool. Moreover, preferred polynucleotides of the invention include purified, isolated, or recombinant GENSET cDNAs consisting of, consisting essentially of, or comprising a nucleotide sequence selected from the group consisting of cDNA inserts of the deposited clone pool.

The polynucleotides of SEQ ID NOs: 1–141 may be interchanged with the corresponding polynucleotides encoded by the human cDNA of the clones inserts of the deposited clone pool. The polypeptides of SEQ ID NOs: 242–482 may be interchanged with the corresponding polypeptides encoded by the human cDNA of the clones inserts of the deposited clone pool. The correspondance between the polynucleotides of SEQ ID Nos: 1–141, the polypeptides of SEQ ID NOs: 242–482 and clones inserts of the deposited clone pool is given in Table I.

cDNA Sequences of the Invention

Another object of the invention is a purified, isolated, or recombinant polynucleotide comprising a nucleotide sequence selected from the group consisting of sequences of SEQ ID Nos: 1–241, complementary sequences thereto, and fragments thereof. Moreover, preferred polynucleotides of the invention include purified, isolated, or recombinant GENSET cDNAs consisting of, consisting essentially of, or comprising a sequence selected from the group consisting of SEQ ID Nos: 1–241.

Polynucleotides GENSET sequences of SEQ ID Nos: 1–241 were then searched for open reading frames able to encode polypeptides. The GENSET ORFs were also searched to identify potential signal sequence motifs using slight modifications of the procedures disclosed in Von Heijne, *Nucleic Acids Res*. 14:4683–4690, 1986, as described in PCT publication WO 00/37491, the entire disclosures of which are incorporated herein by reference. The GENSET cDNAs of SEQ ID Nos: 1–31 and 33–143 encoding polypeptides of SEQ ID Nos: 242–272 and 274–384 were thus found as containing such signal sequences.

Structural parameters of each of the cDNA of the present invention are described in Table II. Namely, Table II provides, for each cDNA of SEQ ID Nos: 1–241 referred to by its sequence identification number (column entitled "Seq Id No"), the locations of the first and last nucleotides of the coding sequences (listed under the heading "Full Coding Sequence"), and, if applicable, the locations of the signal sequence and the sequence encoding the mature polypeptide in the case of secreted proteins (SEQ ID Nos: 1–31 and 33–143) listed under the headings "Signal Sequence" and "Coding Sequence for the mature Protein" respectively, the locations of the first and last nucleotides of the polyA signals (listed under the heading "Poly A Signal") and the locations of the first and last nucleotides of the polyA sites (listed under the heading "Poly A Site").

Accordingly, the full coding sequence (CDS) or open reading frame (ORF) of each cDNA of the invention refers to the nucleotide sequence beginning with the first nucleotide of the start codon and ending with the last nucleotide of the stop codon (see column entiled "Full coding sequence" of Table II for sequences of Seq Id Nos: 1–241). Similarly, the signal sequence of each cDNA of the invention refers to the nucleotide sequence beginning with the first nucleotide of the start codon and ending with the last nucleotide of the codon encoding the signal peptide (see column entiled "Signal sequence" of Table II for sequences of Seq Id Nos: 1–31 and 33–143) and the coding sequence for the mature polypeptide of each cDNA of the invention refers to the nucleotide sequence beginning with the first nucleotide of the first codon encoding and ending with the last nucleotide of the stop codon (see column entiled "Coding sequence for mature protein" of Table II for sequences of Seq Id Nos: 1–31 and 33–143). Similarly, the 5' untranslated region (or 5'UTR) of each cDNA of the invention refers to the nucleotide sequence starting at nucleotide 1 and ending at the nucleotide immediately 5' to the first nucleotide of the start codon. The 3' untranslated region (or 3'UTR) of each cDNA of the invention refers to the nucleotide sequence starting at the nucleotide immediately 3' to the last nucleotide of the stop codon and ending at the last nucleotide of the cDNA.

Untranslated Regions

In addition, the invention concerns a purified, isolated, and recombinant nucleic acid comprising a nucleotide sequence selected from the group consisting of the 5'UTRs of sequences of SEQ ID Nos: 1–241 and sequences of clone inserts of the deposited clone pool, sequences complementary thereto, and allelic variants thereof. The invention also concerns a purified, isolated, and recombinant nucleic acid comprising a nucleotide sequence selected from the group consisting of the 3'UTRs of sequences of SEQ ID Nos: 1–241 and sequences of clone inserts of the deposited clone pool, sequences complementary thereto, and allelic variants thereof.

These polynucleotides may be used to detect the presence of GENSET mRNA species in a biological sample using either hybridization or RT-PCR techniques well known to those skilled in the art those skilled in the art.

In addition, these polynucleotides may be used as regulatory molecules able to affect the processing and maturation of the polynucleotide including them (either a GENSET polynucleotide or an heterologous polynucleotide), preferably the localization, stability and/or translation of said polynucleotide including them (for a review on UTRs see Decker and Parker, 1995, Derrigo et al., 2000). In particular, 3'UTRs may be used in order to control the stability of heterologous mRNAs in recombinant vectors using any methods known to those skilled in the art including Makrides (1999), U.S. Pat. Nos. 5,925,56; 5,807,7 and 5,756,264, which disclosures are hereby incorporated by reference in their entireties.

Coding Sequences

Another object of the invention is an isolated, purified or recombinant polynucleotide comprising the full coding sequence of a sequence selected from the group consisting of sequences of SEQ ID Nos: 1–241, clone inserts of the deposited clone pool, and variants thereof.

A further object of the invention is an isolated, purified or recombinant polynucleotide encoding a polypeptide comprising a sequence selected from the group consisting of sequences of SEQ ID Nos: 242–482 and allelic variants thereof. Another object of the invention is an isolated, purified or recombinant polynucleotide encoding a polypeptide comprising a sequence selected from the group consisting of polypeptides encoded by cDNA inserts of the deposited clone pool and allelic variants thereof.

In a preferred embodiment, the invention encompasses an isolated, purified or recombinant polynucleotide encoding a polypeptide comprising a sequence selected from the group consisting of the mature proteins of SEQ ID Nos: 242–272 and 274–384. In another preferred embodiment, the invention encompasses an isolated, purified or recombinant polynucleotide encoding a polypeptide comprising a sequence selected from the group consisting of the signal peptides of SEQ ID Nos: 242–272 and 274–384.

It will be appreciated that should the extent of the full coding sequence differ from that indicated in the appended sequence listing as a result of a sequencing error, reverse transcription or amplification error, mRNA splicing, post-translational modification of the encoded protein, enzymatic cleavage of the encoded protein, or other biological factors, one skilled in the art would be readily able to identify the extent of the full coding sequences in the sequences of SEQ ID Nos: 1–241. Accordingly, the scope of any claims herein relating to nucleic acids containing the full coding sequence of one of SEQ ID Nos: 1–241 is not to be construed as excluding any readily identifiable variations from or equivalents to the full coding sequences described in the appended sequence listing. Similarly, should the extent of the polypeptides differ from those indicated in the appended sequence listing as a result of any of the preceding factors, the scope of claims relating to polypeptides comprising the amino acid sequence of the polypeptides of SEQ ID Nos: 242–482 is not to be construed as excluding any readily identifiable variations from or equivalents to the sequences described in the appended sequence listing.

It will be appreciated that should the extent of the coding sequence of the mature protein differ from that indicated in the appended sequence listing as a result of a sequencing error, reverse transcription or amplification error, mRNA splicing, post-translational modification of the encoded protein, enzymatic cleavage of the encoded protein, or other biological factors, one skilled in the art would be readily able to identify the extent of the coding sequences for the mature protein in the sequences of SEQ ID Nos: 1–31 and 33–143. Accordingly, the scope of any claims herein relating to nucleic acids containing the coding sequence for the mature proteins of one of SEQ ID Nos: 1–31 and 33–143 is not to be construed as excluding any readily identifiable variations from or equivalents to the coding sequences described in the appended sequence listing. Similarly, should the extent of the mature polypeptides differ from those indicated in the appended sequence listing as a result of any of the preceding factors, the scope of claims relating to mature polypeptides comprising the amino acid sequence of the polypeptides of SEQ ID Nos: 242–272 and 274–384 is not to be construed as excluding any readily identifiable variations from or equivalents to the sequences described in the appended sequence listing.

It will be appreciated that should the extent of the coding sequence of the signal peptide differ from that indicated in the appended sequence listing as a result of a sequencing error, reverse transcription or amplification error, mRNA splicing, post-translational modification of the encoded protein, enzymatic cleavage of the encoded protein, or other biological factors, one skilled in the art would be readily able to identify the extent of the coding sequences for the signal peptide in the sequences of SEQ ID Nos: 1–31 and 33–143. Accordingly, the scope of any claims herein relating to nucleic acids containing the signal sequence of one of SEQ ID Nos: 1–31 and 33–143 is not to be construed as excluding any readily identifiable variations from or equivalents to the coding sequences described in the appended sequence listing. Similarly, should the extent of the signal peptides differ from those indicated in the appended sequence listing as a result of any of the preceding factors, the scope of claims relating to signal peptides comprising the amino acid sequence of the polypeptides of SEQ ID Nos: 242–272 and 274–384 is not to be construed as excluding any readily identifiable variations from or equivalents to the sequences described in the appended sequence listing.

The above disclosed polynucleotides that contains the coding sequence (for the full-length protein of for the mature protein) of the GENSET genes may be expressed in a desired host cell or a desired host organism, when this polynucleotide is placed under the control of suitable expression signals. The expression signals may be either the expression signals contained in the regulatory regions in the GENSET genes of the invention or in contrast the signals may be exogenous regulatory nucleic sequences. Such a polynucleotide, when placed under the suitable expression signals, may also be inserted in a vector for its expression and/or amplification.

Further included in the present invention are polynucleotides encoding the polypeptides of the present invention that are fused in frame to the coding sequences for additional heterologous amino acid sequences. Of special interest are polynucleotides comprising GENSET signal sequences fused to an heterologous polypeptide as described in the section entitled "Secretion vectors". Also included in the present invention are nucleic acids encoding polypeptides of the present invention together with additional, non-coding sequences, including for example, but not limited to non-coding 5' and 3' sequences, vector sequence, sequences used for purification, probing, or priming. For example, heterologous sequences include transcribed, untranslated sequences that may play a role in transcription, and mRNA processing, for example, ribosome binding and stability of mRNA. The heterologous sequences may alternatively comprise additional coding sequences that provide additional functionalities. Thus, a nucleotide sequence encoding a polypeptide may be fused to a tag sequence, such as a sequence encoding a peptide that facilitates purification of the fused polypeptide. In certain preferred embodiments of this aspect of the invention, the tag amino acid sequence is a hexa-histidine peptide, such as the tag provided in a pQE vector (QIAGEN), among others, many of which are commercially available. For instance, hexa-histidine provides for convenient purification of the fusion protein (See Gentz et al., 1989), the disclosure of which is incorporated by reference in its entirety. The "HA" tag is another peptide useful for purification which corresponds to an epitope derived from the influenza hemagglutinin protein (See Wilson et al., 1984), the disclosure of which is incorporated by reference in its entirety. As discussed below other such fusion proteins include the GENSET protein fused to Fc at the N- or C-terminus.

Suitable recombinant vectors that contain a polynucleotide such as described herein are disclosed elsewhere in the specification. Expression vectors encoding GENSET polypeptides or fragments thereof are described in the section entitled "Preparation of the polypeptides".

Regulatory Sequences of the Invention

As mentioned, the genomic sequence of GENSET genes contains regulatory sequences in the non-coding 5'-flanking region and possibly in the non-coding 3'-flanking region that border the GENSET coding regions containing the exons of these genes.

Polynucleotides derived from GENSET 5' and 3' regulatory regions are useful in order to detect the presence of at least a copy of a genomic nucleotide sequence of the GENSET gene or a fragment thereof in a test sample.

Preferred Regulatory Sequences

Polynucleotides carrying the regulatory elements located at the 5' end and at the 3' end of GENSET coding regions may be advantageously used to control the transcriptional and translational activity of a heterologous polynucleotide of interest.

Thus, the present invention also concerns a purified or isolated nucleic acid comprising a polynucleotide which is selected from the group consisting of the 5' and 3' GENSET regulatory regions, sequences complementary thereto, regulatory active fragments and variants thereof. The invention also pertains to a purified or isolated nucleic acid comprising a polynucleotide having at least 95% nucleotide identity with a polynucleotide selected from the group consisting of GENSET 5' and 3' regulatory regions, advantageously 99% nucleotide identity, preferably 99.5% nucleotide identity and most preferably 99.8% nucleotide identity with a polynucleotide selected from the group consisting of GENSET 5' and 3' regulatory regions, sequences complementary thereto, variants and regulatory active fragments thereof.

Another object of the invention consists of purified, isolated or recombinant nucleic acids comprising a polynucleotide that hybridizes, under the stringent hybridization conditions defined herein, with a polynucleotide selected from the group consisting of the nucleotide sequences of GENSET 5'- and 3' regulatory regions, sequences complementary thereto, variants and regulatory active fragments thereof.

Preferred fragments of 5' regulatory regions have a length of about 1500 or 1000 nucleotides, preferably of about 500 nucleotides, more preferably about 400 nucleotides, even more preferably 300 nucleotides and most preferably about 200 nucleotides.

Preferred fragments of 3' regulatory regions are at least 20, 50, 100, 150, 200, 300 or 400 bases in length.

"Providing" with respect to, e.g. a biological sample, population of cells, etc. indicates that the sample, population of cells, etc. is somehow used in a method or procedure. Significantly, "providing" a biological sample or population of cells does not require that the sample or cells are specifically isolated or obtained for the purposes of the invention, but can instead refer, for example, to the use of a biological sample obtained by another individual, for another purpose.

"Regulatory active" polynucleotide derivatives of the 5' regulatory region are polynucleotides comprising or alternatively consisting of a fragment of said polynucleotide which is functional as a regulatory region for expressing a recombinant polypeptide or a recombinant polynucleotide in a recombinant cell host. It could act either as an enhancer or as a repressor. For the purpose of the invention, a nucleic acid or polynucleotide is "functional" as a regulatory region for expressing a recombinant polypeptide or a recombinant polynucleotide if said regulatory polynucleotide contains nucleotide sequences which contain transcriptional and translational regulatory information, and such sequences are "operably linked" to nucleotide sequences which encode the desired polypeptide or the desired polynucleotide.

The regulatory polynucleotides of the invention may be prepared from the nucleotide sequence of GENSET genomic or cDNA sequence, for example, by cleavage using suitable restriction enzymes, or by PCR. The regulatory polynucleotides may also be prepared by digestion of a GENSET gene containing genomic clone by an exonuclease enzyme, such as Bal31 (Wabiko et al., 1986), the disclosure of which is incorporated by reference in its entirety. These regulatory polynucleotides can also be prepared by nucleic acid chemical synthesis, as described elsewhere in the specification.

The regulatory polynucleotides according to the invention may be part of a recombinant expression vector that may be used to express a full coding sequence in a desired host cell or host organism. The recombinant expression vectors according to the invention are described elsewhere in the specification.

Preferred 5'-regulatory polynucleotide of the invention include 5'-UTRs of GENSET cDNAs, or regulatory active fragments or variants thereof. More preferred 5'-regulatory polynucleotides of the invention include sequences selected from the group consisting of 5'-UTRs of sequences of SEQ ID Nos: 1–241, 5'-UTRs of clones inserts of the deposited clone pool, regulatory active fragments and variants thereof.

Preferred 3'-regulatory polynucleotide of the invention include 3'-UTRs of GENSET cDNAs, or regulatory active fragments or variants thereof. More preferred 3'-regulatory polynucleotides of the invention include sequences selected from the group consisting of 3'-UTRs of sequences of SEQ ID Nos: 1–241, 3'-UTRs of clones inserts of the deposited clone pool, regulatory active fragments and variants thereof.

A further object of the invention consists of a purified or isolated nucleic acid comprising:

a) a polynucleotide comprising a 5' regulatory nucleotide sequence selected from the group consisting of:

(i) a nucleotide sequence comprising a polynucleotide of a GENSET 5' regulatory region or a complementary sequence thereto;

(ii) a nucleotide sequence comprising a polynucleotide having at least 95% of nucleotide identity with the nucleotide sequence of a GENSET 5' regulatory region or a complementary sequence thereto;

(iii) a nucleotide sequence comprising a polynucleotide that hybridizes under stringent hybridization conditions with the nucleotide sequence of a GENSET 5' regulatory region or a complementary sequence thereto; and (iv) a regulatory active fragment or variant of the polynucleotides in (i), (ii) and (iii);

b) a nucleic acid molecule encoding a desired polypeptide or a nucleic acid molecule of interest, said nucleic acid molecule is operably linked to the polynucleotide defined in (a); and c) optionally, a polynucleotide comprising a 3'-regulatory polynucleotide, preferably a 3'-regulatory polynucleotide of a GENSET gene.

In a specific embodiment, the nucleic acid defined above includes the 5'-UTR of a GENSET cDNA, or a regulatory active fragment or variant thereof.

In a second specific embodiment, the nucleic acid defined above includes the 3'-UTR of a GENSET cDNA, or a regulatory active fragment or variant thereof.

The regulatory polynucleotide of the 5' regulatory region, or its regulatory active fragments or variants, is operably linked at the 5'-end of the nucleic acid molecule encoding the desired polypeptide or nucleic acid molecule of interest.

The regulatory polynucleotide of the 3' regulatory region, or its regulatory active fragments or variants, is advantageously operably linked at the 3'-end of the nucleic acid molecule encoding the desired polypeptide or nucleic acid molecule of interest.

The desired polypeptide encoded by the above-described nucleic acid may be of various nature or origin, encompassing proteins of prokaryotic viral or eukaryotic origin. Among the polypeptides expressed under the control of a GENSET regulatory region include bacterial, fungal or viral antigens. Also encompassed are eukaryotic proteins such as intracellular proteins, such as "house keeping" proteins, membrane-bound proteins, such as mitochondrial membrane-bound proteins and cell surface receptors, and secreted proteins such as endogenous mediators such as cytokines. The desired polypeptide may be an heterologous polypeptide or a GENSET protein, especially a protein with an amino acid sequence selected from the group consisting of sequences of SEQ ID Nos: 242–482, fragments and variants thereof.

The desired nucleic acids encoded by the above-described polynucleotide, usually an RNA molecule, may be complementary to a desired coding polynucleotide, for example to a GENSET coding sequence, and thus useful as an antisense polynucleotide. Such a polynucleotide may be included in a recombinant expression vector in order to express the desired polypeptide or the desired nucleic acid in host cell or in a host organism. Suitable recombinant vectors that contain a polynucleotide such as described herein are disclosed elsewhere in the specification. When a polynucleotide sequence has been recombinantly introduced into a host cell, the cell is said to be "recombinant" for the polynucleotide.

Polynucleotide Variants

The invention also relates to variants of the polynucleotides described herein and fragments thereof. "Variants" of polynucleotides, as the term is used herein, are polynucleotides that differ from a reference polynucleotide. Generally, differences are limited so that the nucleotide sequences of the reference and the variant are closely similar overall and, in many regions, identical. The present invention encompasses both allelic variants and degenerate variants.

Examples of variant sequences of polynucleotides of the invention are given in the appended sequence listing. Table III lists the sequence identification number of all similar sequences of the sequence listing, namely variants. All cDNAS referred to by their sequence identification number on a given line of the table are thought to be variants of the same GENSET gene.

Allelic Variant

A variant of a polynucleotide may be a naturally occurring variant such as a naturally occurring allelic variant, or it may be a variant that is not known to occur naturally. By an "allelic variant" is intended one of several alternate forms of a gene occupying a given locus on a chromosome of an organism (see Lewin, 1990), the disclosure of which is incorporated by reference in its entirety. Diploid organisms may be homozygous or heterozygous for an allelic form. Non-naturally occurring variants of the polynucleotide may be made by art-known mutagenesis techniques, including those applied to polynucleotides, cells or organisms.

Degenerate Variant

In addition to the isolated polynucleotides of the present invention, and fragments thereof, the invention further includes polynucleotides which comprise a sequence substantially different from those described above but which, due to the degeneracy of the genetic code, still encode a GENSET polypeptide of the present invention. These polynucleotide variants are referred to as "degenerate variants" throughout the instant application. That is, all possible polynucleotide sequences that encode the GENSET polypeptides of the present invention are completed. This includes the genetic code and species-specific codon preferences known in the art. Thus, it would be routine for one skilled in the art to generate the degenerate variants described above, for instance, to optimize codon expression for a particular host (e.g., change codons in the human mRNA to those preferred by other mammalian or bacterial host cells).

Nucleotide changes present in a variant polynucleotide may be silent, which means that they do not alter the amino acids encoded by the polynucleotide. However, nucleotide changes may also result in amino acid substitutions, additions, deletions, fusions and truncations in the polypeptide encoded by the reference sequence. The substitutions, deletions or additions may involve one or more nucleotides. The variants may be altered in coding or non-coding regions or both. Alterations in the coding regions may produce conservative or non-conservative amino acid substitutions, deletions or additions. In the context of the present invention, preferred embodiments are those in which the polynucleotide variants encode polypeptides which retain substantially the same biological properties or activities as the GENSET protein. More preferred polynucleotide variants are those containing conservative substitutions.

Similar Polynucleotides

Other embodiments of the present invention is a purified, isolated or recombinant polynucleotide which is at least 90%, 95%, 96%, 97%, 98% or 99% identical to a polynucleotide selected from the group consisting of sequences of SEQ ID Nos: 1–241 and clone inserts of the deposited clone pool. The above polynucleotides are included regardless of whether they encode a polypeptide having a GENSET biological activity. This is because even where a particular nucleic acid molecule does not encode a polypeptide having activity, one of skill in the art would still know how to use the nucleic acid molecule, for instance, as a hybridization probe or primer. Uses of the nucleic acid molecules of the present invention that do not encode a polypeptide having GENSET activity include, inter alia, isolating a GENSET gene or allelic variants thereof from a DNA library, and detecting GENSET mRNA expression in biological samples, suspected of containing GENSET mRNA or DNA by Northern Blot or PCR analysis.

The present invention is further directed to polynucleotides having sequences at least 50%, 60%, 70%, 80%, 90%, 95%, 96%, 97%, 98% or 99% identity to a polynucleotide selected from the group consisting of sequences of SEQ ID Nos: 1–241 and clone inserts of the deposited clone pool, where said polynucleotide do, in fact, encode a polypeptide having a GENSET biological activity. Of course, due to the degeneracy of the genetic code, one of ordinary skill in the art will immediately recognize that a large number of the polynucleotides at least 50%, 60%, 70%, 80%, 90%, 95%, 96%, 97%, 98%, or 99% identical to a polynucleotide selected from the group consisting of sequences of SEQ ID Nos: 1–241 and clone inserts of the deposited clone pool will encode a polypeptide having biological activity. In fact, since degenerate variants of these nucleotide sequences all encode the same polypeptide, this will be clear to the skilled artisan even without performing the above described comparison assay. It will be further recognized in the art that, for such nucleic acid molecules that are not degenerate variants, a reasonable number will also encode a polypeptide having biological activity. This is because the skilled artisan is fully aware of amino acid substitutions that are either less likely or not likely to significantly effect protein function (e.g., replacing one aliphatic amino acid with a second aliphatic amino acid), as further described below. By a polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence encoding the GENSET polypeptide. In other words, to obtain a polynucleotide having a nucleotide sequence at least 95% identical to a reference nucleotide sequence, up to 5% of the nucleotides in the reference sequence may be deleted, inserted, or substituted with another nucleotide. The query sequence may be an entire sequence selected from the group consisting of sequences of SEQ ID Nos: 1–241 and sequences of clone inserts of the deposited clone pool, or the ORF (open reading frame) of a polynucleotide sequence selected from said group, or any fragment specified as described herein.

Hybridizing Polynucleotides

In another aspect, the invention provides an isolated or purified nucleic acid molecule comprising a polynucleotide which hybridizes under stringent hybridization conditions to any polynucleotide of the present invention using any methods known to those skilled in the art including those disclosed herein and in particular in the "To find similar sequences" section. Also contemplated are nucleic acid molecules that hybridize to the polynucleotides of the present invention at lower stringency hybridization conditions, preferably at moderate or low stringency conditions as defined herein. Such hybridizing polynucleotides may be of at least 15, 18, 20, 23, 25, 28, 30, 35, 40, 50, 75, 100, 200, 300, 500, 1000 or 2000 nucleotides in length.

Of particular interest, are the polynucleotides hybridizing to any polynucleotide of the invention and encoding GENSET polypeptides, particularly GENSET polypeptides exhibiting a GENSET biological activity.

Of course, a polynucleotide which hybridizes only to polyA+ sequences (such as any 3' terminal polyA+ tract of a cDNA shown in the sequence listing), or to a 5' complementary stretch of T (or U) residues, would not be included in the definition of "polynucleotide," since such a polynucleotide would hybridize to any nucleic acid molecule containing a poly (A) stretch or the complement thereof (e.g., practically any double-stranded cDNA clone generated using oligo dT as a primer).

Complementary Polynucleotides

The invention further provides isolated nucleic acid molecules having a nucleotide sequence fully complementary to any polynucleotide of the invention. The present invention encompasses a purified, isolated or recombinant polynucleotide having a nucleotide sequence complementary to a sequence selected from the group consisting of sequences of SEQ ID Nos: 1–241, sequences of clone inserts of the deposited clone pool and fragments thereof. Such isolated molecules, particularly DNA molecules, are useful as probes for gene mapping and for identifying GENSET mRNA in a biological sample, for instance, by PCR or Northern blot analysis.

Polynucleotides Fragments

The present invention is further directed to polynucleotides encoding portions or fragments of the nucleotide sequences described herein. Uses for the polynucleotide fragments of the present invention include probes, primers, molecular weight markers and for expressing the polypeptide fragments of the present invention. Fragments include portions of polynucleotides selected from the group consisting of a) the sequences of SEQ ID Nos: 1–241, b) the genomic GENSET sequences, c) the polynucleotides encoding a polypeptide selected from the group consisting of the sequences of SEQ ID Nos: 242–482, d) the sequences of clone inserts of the deposited clone pool, and e) the polynucleotides encoding the polypeptides encoded by the clone inserts of the deposited clone pool. Particularly included in the present invention is a purified or isolated polynucleotide comprising at least 8 consecutive bases of a polynucleotide of the present invention. In one aspect of this embodiment, the polynucleotide comprises at least 10, 12, 15, 18, 20, 25, 28, 30, 35, 40, 50, 75, 100, 150, 200, 300, 400, 500, 800, 1000, 1500, or 2000 consecutive nucleotides of a polynucleotide of the present invention.

In addition to the above preferred polynucleotide sizes, further preferred sub-genuses of polynucleotides comprise at least 8 nucleotides, wherein "at least 8" is defined as any integer between 8 and the integer representing the 3' most nucleotide position as set forth in the sequence listing or elsewhere herein. Further included as preferred polynucleotides of the present invention are polynucleotide fragments at least 8 nucleotides in length, as described above, that are further specified in terms of their 5' and 3' position. The 5' and 3' positions are represented by the position numbers set forth in the appended sequence listing. For allelic, degenerate and other variants, position 1 is defined as the 5' most nucleotide of the ORF, i.e., the nucleotide "A" of the start codon with the remaining nucleotides numbered consecutively. Therefore, every combination of a 5' and 3' nucleotide position that a polynucleotide fragment of the present invention, at least 8 contiguous nucleotides in length, could occupy on a polynucleotide of the invention is included in the invention as an individual species. The polynucleotide fragments Specified by 5' and 3' positions can be immediately envisaged and are therefore not individually listed solely for the purpose of not unnecessarily lengthening the specifications.

It is noted that the above species of polynucleotide fragments of the present invention may alternatively be described by the formula "a to b"; where "a" equals the 5' most nucleotide position and "b" equals the 3' most nucleotide position of the polynucleotide; and further where "a" equals an integer between 1 and the number of nucleotides of the polynucleotide sequence of the present invention minus 8, and where "b" equals an integer between 9 and the number of nucleotides of the polynucleotide sequence of the present invention; and where "a" is an integer smaller then "b" by at least 8.

The present invention also provides for the exclusion of any species of polynucleotide fragments of the present invention specified by 5' and 3' positions or sub-genuses of polynucleotides specified by size in nucleotides as described above. Any number of fragments specified by 5' and 3' positions or by size in nucleotides, as described above, may be excluded. Specifically excluded from the invention are the fragments described in Table IV. For these cDNAs referred to by their sequence identification numbers, Table IV gives the positions of excluded fragments within these sequences fragments having substantial homology to polyadenylation tails and to repeated sequences including Alu, Ll, THE and MER repeats, SSTR sequences or satellite, micro-satellite, and telomerc repeats. Each fragment is represented by a–b where a and b are the start and end positions respectively of a given excluded fragment. Excluded fragments are separated from each other by a coma. As used herein the term "polynucleotide described in Table IV" refers to all polynucleotide fragments defined in Table IV in this manner.

Preferred included and excluded polynucleotide fragments of the invention are also described in Tables Va and Table Vb. For these cDNAs referred to by their sequence identification numbers, Tables Va and Table Vb give the positions of preferred fragments within these sequences (columns entitled "Preferentially included fragments") as well as the positions of preferentially excluded fragments (columns entitled "Preferentially excluded fragments"). Each fragment is represented by a–b where a and b are the start and end positions respectively of a given preferred fragment Fragments are separated from each other by a coma. As used herein the term "excluded polynucleotide described in Tables Va and Vb" refers to all polynucleotide preferentially excluded as described in Tables Va and Vb. As used herein the term "preferred polynucleotide described in Tables Va and Vb" refers to all preferrentially included polynucleotide fragments listed in Tables Va and Table Vb in this manner.

Therefore, the present invention encompasses isolated, purified, or recombinant polynucleotides which consist of, consist essentially of, or comprise a contiguous span of at least 8, 10, 12, 15, 18, 20, 25, 28, 30, 35, 40, 50, 75, 100, 150, 200, 300, 400, 500, 1000 or 2000 nucleotides of a sequence selected from the group consisting of the sequences of SEQ ID Nos: 1–241 and sequences fully complimentary hereto, to the extent that a contiguous span of these lengths is consistent with the lengths of said selected sequence, wherein said contiguous span comprises at least 1, 2, 3, 5, 10, 15, 18, 20, 25, 28, 30, 35, 40, 50, 75, 100, 150, 200, 300, 400 or 500 nucleotides of a preferred polynucleotide described in Tables Va and Vb, or a sequence complementary hereto. The present invention also encompasses isolated, purified, or recombinant polynucleotides comprising, consisting essentially of, or consisting of a contiguous span of at least 8, 10, 12, 15, 18, 20, 25, 28, 30, 35, 40, 50, 75, 100, 150, 200, 300, 400, 500, 1000 or 2000 nucleotides of a polynucleotide selected from the group consisting of the sequences of SEQ ID Nos: 1–241 and sequences fully complementary thereto, wherein said contiguous span comprises a preferred polynucleotide described in Tables Va and Vb, or a sequence complementary thereto, to the extent that a contiguous span of these lengths is consistent with the length of the selected sequence. The present invention also encompasses isolated, purified, or recombinant nucleic acids which comprise, consist of or consist essentially of a contiguous span of a polynucleotide selected from the group consisting of the sequences of SEQ ID Nos: 1–241 and sequences fully complementary thereto, wherein said contiguous span comprises preferred polynucleotide described in Tables Va and Vb, or a sequence complementary thereto.

Other preferred fragments of the invention are polynucleotides comprising polynucleotides encoding domains of polypeptides. Such fragments may be used to obtain other polynucleotides encoding polypeptides having similar domains using hybridization or RT-PCR techniques. Alternatively, these fragments may be used to express a polypeptide domain which may present a specific biological property. Preferred domains for the GENSET polypeptides of the invention are described in Table VI. Thus, another object of the invention is an isolated, purified or recombinant polynucleotide encoding a polypeptide consisting of, consisting essentially of, or comprising a contiguous span of at least 5, 6, 8, 10, 12, 15, 20, 25, 30, 35, 40, 50, 60, 75, 100, 150, 200, 250, 300, 350, 400, 450 or 500 consecutive amino acids of a sequence selected from the group consisting of the sequences of SEQ ID Nos: 242–482, to the extent that a contiguous span of these lengths is consistent with the lengths of said selected sequence, where said contiguous span comprises at least 1, 2, 3, 5, or 10 of the amino acid positions of a domain of said selected sequence. The present invention also encompasses isolated, purified or recombinant polynucleotides encoding a polypeptide comprising a contiguous span of at least 5, 6, 8, 10, 12, 15, 20, 25, 30, 35, 40, 50, 60, 75, 100, 150, 200, 250, 300, 350, 400, 450 or 500 consecutive amino acids of a sequence selected from the group consisting of sequences of SEQ ID Nos: 242–482, to the extent that a contiguous span of these lengths is consistent with the lengths of said selected sequence, where said contiguous span is a domain of said selected sequence. The present invention also encompasses isolated, purified or recombinant polynucleotides encoding a polypeptide comprising a domain of a sequence selected from the group consisting of the sequences of SEQ ID Nos: 242–482.

The present invention further encompasses any combination of the polynucleotide fragments listed in this section.

Oligonucleotide Primers and Probes

The present invention also encompasses fragments of GENSET polynucleotides for use as primers and probes. Polynucleotides derived from the GENSET genomic and cDNA sequences are useful in order to detect the presence of at least a copy of a GENSET polynucleotide or fragment, complement, or variant thereof in a test sample.

Structural Definition

Any polynucleotide of the invention may be used as a primer or probe. Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, 1000, 1500 or 2000 nucleotides of a sequence selected from the group consisting of the GENSET genomic sequences, the cDNA sequences and the sequences fully complementary thereto. Another object of the invention is a purified, isolated, or recombinant polynucleotide comprising the nucleotide sequence of a sequence selected from the group consisting of the sequences of SEQ ID Nos: 1–241, sequences of clone inserts of the deposited clone pool, sequences fully complementary thereto, allelic variants thereof, and fragments thereof. Moreover, preferred probes and primers of the invention include purified, isolated, or recombinant GENSET cDNAs consisting of, consisting essentially of, or comprising the sequences of SEQ ID Nos: 1–241 and sequences of clone inserts of the deposited clone pool. Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, 1000, 1500 or 2000 nucleotides of a sequence selected from the group consisting of the sequences of SEQ ID Nos: 1–241 and the sequences fully complementary thereto. *f*

Design of Primers and Probes

A probe or a primer according to the invention has between 8 and 1000 nucleotides in length, or is specified to be at least 12, 15, 18, 20, 25, 35, 40, 50, 60, 70, 80, 100, 250, 500, 1000, 1500 or 2000 nucleotides in length. More particularly, the length of these probes and primers can range from 8, 10, 15, 20, or 30 to 100 nucleotides, preferably from 10 to 50, more preferably from 15 to 30 nucleotides. Shorter probes and primers tend to lack specificity for a target nucleic acid sequence and generally require cooler temperatures to form sufficiently stable hybrid complexes with the template. Longer probes and primers are expensive to produce and can sometimes self-hybridize to form hairpin structures. The appropriate length for primers and probes under a particular set of assay conditions may be empirically determined by one of skill in the art. The formation of stable hybrids depends on the melting temperature (Tm) of the DNA. The Tm depends on the length of the primer or probe, the ionic strength of the solution and the G+C content. The higher the G+C content of the primer or probe, the higher is the melting temperature because G:C pairs are held by three H bonds whereas A:T pairs have only two. The GC content in the probes of the invention usually ranges between 10 and 75%, preferably between 35 and 60%, and more preferably between 40 and 55%.

For amplification purposes, pairs of primers with approximately the same Tm are preferable. Primers may be designed using the OSP software (Hillier and Green, 1991), the disclosure of which is incorporated by reference in its entirety, based on GC content and melting temperatures of oligonucleotides, or using PC-Rare (http://bioinformatics.weizmann.ac.il/software/PC-Rare/doc/manuel.html) based on the octamer frequency disparity method (Griffais et al., 1991), the disclosure of which is incorporated by reference in its entirety. DNA amplification techniques are well known to those skilled in the art. Amplification techniques that can be used in the context of the present invention include, but are not limited to, the ligase chain reaction (LCR) described in EP-A-320 308, WO 9320227 and EP-A-439 182, the polymerase chain reaction (PCR, RT-PCR) and techniques such as the nucleic acid sequence based amplification (NASBA) described in Guatelli et al. (1990) and in Compton (1991), Q-beta amplification as described in European Patent Application No 4544610, strand displacement amplification as described in Walker et al. (1996) and EP A 684 315 and, target mediated amplification as described in PCT Publication WO 9322461, the disclosures of which are incorporated by reference in their entireties.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3' hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes, which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227), the disclosure of which is incorporated by reference in its entirety. Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall et al. (1994), the disclosures of which are incorporated by reference in its entireties. AGLCR is a modification of GLCR that allows the amplification of RNA.

The PCR technology is the preferred amplification technique used in the present invention. A variety of PCR techniques are familiar to those skilled in the art. For a review of PCR technology, see White (1997), Erlich (1992) and the publication entitled "PCR Methods and Applications" (1991, Cold Spring Harbor Laboratory Press), the disclosures of which are incorporated by reference in its entireties. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, Tth polymerase or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195; 4,683,202; and 4,965,188, the disclosures of which are incorporated herein by reference in their entireties.

Preparation of Primers and Probes

The primers and probes can be prepared by any suitable method, including, for example, cloning and restriction of appropriate sequences and direct chemical synthesis by a method such as the phosphodiester method of Narang et al. (1979), the phosphodiester method of Brown et al. (1979), the diethylphosphoramidite method of Beaucage et al. (1981) and the solid support method described in EP 0 707 592, which disclosures are hereby incorporated by reference in their entireties.

Detection probes are generally nucleic acid sequences or uncharged nucleic acid analogs such as, for example peptide nucleic acids which are disclosed in International Patent Application WO 92/20702, morpholino analogs which are described in U.S. Pat. Nos. 5,185,444; 5,034,506 and 5,142,047, which disclosures are hereby incorporated by reference in their entireties. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionality with the capture or detection label to thereby consume or otherwise block the hydroxyl group. Alternatively, the 3' hydroxyl group simply can be cleaved, replaced or modified, U.S. patent application Ser. No. 07/049,061 filed Apr. 19, 1993, which disclosure is hereby incorporated by reference in its entirety, describes modifications, which can be used to render a probe non-extendable.

Labeling of Probes

Any of the polynucleotides of the present invention can be labeled, if desired, by incorporating any label known in the art to be detectable by spectroscopic, photochemical, biochemical, immunochemical, or chemical means. For example, useful labels include radioactive substances (including, $^{32}P$, $^{35}S$, $^{3}H$, $^{125}I$), fluorescent dyes (including, 5-bromodesoxyuridin, fluorescein, acetylaminofluorene, digoxigenin) or biotin. Preferably, polynucleotides are labeled at their 3' and 5' ends. Examples of non-radioactive labeling of nucleic acid fragments are described in the French patent No. FR-7810975 or by Urdea et al (1988) or Sanchez-Pescador et al (1988), which disclosures are hereby incorporated by reference in their entireties. In addition, the probes according to the present invention may have structural characteristics such that they allow the signal amplification, such structural characteristics being, for example, branched DNA probes as those described by Urdea et al. in 1991 or in the European patent No. EP 0 225 807 (Chiron), which disclosures are hereby incorporated by reference in their entireties.

The detectable probe may be single stranded or double stranded and may be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it may be denatured prior to contacting the probe. In some applications, the nucleic acid sample may be immobilized on a surface such as a nitrocellulose or nylon membrane. The nucleic acid sample may comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe may be cloned into vectors such as expression vectors, sequencing vectors, or in vitro transcription vectors to facilitate the characterization and expression of the hybridizing nucleic acids in the sample. For example, such techniques may be used to isolate and clone sequences in a genomic library or cDNA library which are capable of hybridizing to the detectable probe as described herein.

Immobilization of Probes

A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

The probes of the present invention are useful for a number of purposes. They can be notably used in Southern hybridization to genomic DNA. The probes can also be used to detect PCR amplification products. They may also be used to detect mismatches in the GENSET gene or mRNA using other techniques.

Any of the polynucleotides, primers and probes of the present invention can be conveniently immobilized on a solid support. The solid support is not critical and can be selected by one skilled in the art. Thus, latex particles, microparticles, magnetic beads, non-magnetic beads (including polystyrene beads), membranes (including nitrocellulose strips), plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or nonmagnetic metal, glass or silicon surface of a test tube, microtiter well, sheet, bead, microparticle, chip, sheep (or other suitable animal's) red blood cells, duracytes® and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the invention to a single solid support. In addition, polynucleotides other than those of the invention may be attached to the same solid support as one or more polynucleotides of the invention.

Oligonucleotide Array

A substrate comprising a plurality of oligonucleotide primers or probes of the invention may be used either for detecting or amplifying targeted sequences in GENSET genes, may also be used for detecting mutations in the coding or in the non-coding sequences of GENSET genes, and may also be used to determine GENSET gene expression in different contexts such as in different tissues, at different stages of a process (embryo development, disease treatment), and in patients versus healthy individuals as described elsewhere in the application.

As used herein, the term "array" means a one dimensional, two dimensional, or multidimensional arrangement of nucleic acids of sufficient length to permit specific detection of gene expression. For example, the array may contain a plurality of nucleic acids derived from genes whose expression levels are to be assessed. The array may include a GENSET genomic DNA, a GENSET cDNA, sequences complementary thereto or fragments thereof. Preferably, the fragments are at least 12, 15, 18, 20, 25, 30, 35, 40 or 50 nucleotides in length. More preferably, the fragments are at least 100 nucleotides in length. Even more preferably, the fragments are more than 100 nucleotides in length. In some embodiments the fragments may be more than 500 nucleotides in length.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as the Genechips™, and has been generally described in U.S. Pat. No. 5,143,854; PCT publications WO 90/15070 and 92/10092, which disclosures are hereby incorporated by reference in their entireties. These arrays may generally be produced using mechanical synthesis methods or light directed synthesis methods which incorporate a combination of photolithographic methods and solid phase oligonucleotide synthesis (Fodor et al., 1991), which disclosure is hereby incorporated by reference in its entirety. The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854; and 5,412,087 and in PCT Publications WO 90/15070, WO 92/10092 and WO 95/11995, which disclosures are hereby incorporated by reference in their entireties, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256, the disclosures of which are incorporated herein by reference in their entireties.

Consequently, the invention concerns an array of nucleic acid molecules comprising at least one polynucleotide of the invention, particularly a probe or primer as described herein. Preferably, the invention concerns an array of nucleic acid comprising at least two polynucleotides of the invention, particularly probes or primers as described herein. Preferably, the invention concerns an array of nucleic acid comprising at least five polynucleotides of the invention, particularly probes or primers as described herein.

A preferred embodiment of the present invention is an array of polynucleotides of at least 12, 15, 18, 20, 25, 30, 35, 40, 50, 100, 500, 1000, 1500 or 2000 nucleotides in length which includes at least 1, 2, 5, 10, 15, 20, 35, 50, 100, 150 or 200 sequences selected from the group consisting of the sequences of SEQ ID Nos: 1–241 and sequences of clone inserts of the deposited clone pool, sequences fully complementary thereto, and fragments thereof.

Methods of Making the Polynucleotides of the Invention

The present invention also comprises methods of making the polynucleotides of the invention, including the polynucleotides of SEQ ID Nos: 1–241, genomic DNA obtainable therefrom, or fragment thereof. These methods comprise sequentially linking together nucleotides to produce the nucleic acids having the preceding sequences. Polynucleotides of the invention may be synthesized either enzymatically using techniques well known to those skilled in the art including amplification or hybridization-based methods as described herein, or chemically.

A variety of chemical methods of synthesizing nucleic acids are known to those skilled in the art. In many of these methods, synthesis is conducted on a solid support. These included the 3' phosphoramidite methods in which the 3' terminal base of the desired oligonucleotide is immobilized on an insoluble carrier. The nucleotide base to be added is blocked at the 5' hydroxyl and activated at the 3' hydroxyl so as to cause coupling with the immobilized nucleotide base. Deblocking of the new immobilized nucleotide compound and repetition of the cycle will produce the desired polynucleotide. Alternatively, polynucleotides may be prepared as described in U.S. Pat. No. 5,049,656, which disclosure is hereby incorporated by reference in its entirety. In some embodiments, several polynucleotides prepared as described above are ligated together to generate longer polynucleotides having a desired sequence.

Polypeptides of the Invention

The term "GENSET polypeptides" is used herein to embrace all of the proteins and polypeptides of the present invention. The present invention encompasses GENSET polypeptides, including recombinant, isolated or purified GENSET polypeptides consisting of, consisting essentially of, or comprising a sequence selected from the group consisting of SEQ ID Nos: 242–482, the polypeptides encoded by human cDNAs contained in the deposited clones, the mature proteins included in SEQ ID Nos: 242–272 and 274–384, mature proteins encoded by the clone inserts of the deposited clone pool, and variants thereof. Other objects of the invention are polypeptides encoded by the polynucleotides of the invention as well as fusion polypeptides comprising such polypeptide.

Polypeptide Variants

The present invention further provides for GENSET polypeptides encoded by allelic and splice variants, orthologs, and/or species homologues. Procedures known in the art can be used to obtain, allelic variants, splice variants, orthologs, and/or species homologues of polynucleotides encoding by polypeptides of the group consisting of SEQ ID Nos: 242–482, mature proteins included in SEQ ID Nos: 242–272 and 274–384, and polypeptides either fill-length or mature encoded by the clone inserts of the deposited clone pool, using information from the sequences disclosed herein or the clones deposited with the ATCC.

The polypeptides of the present invention also include polypeptides having an amino acid sequence at least 50% identical, more preferably at least 60% identical, and still more preferably 70%, 80%, 90%, 95%, 96%, 97%, 98% or 99% identical to a polypeptide selected from the group consisting of the sequences of SEQ ID Nos: 242–482, mature proteins included in sequences of SEQ ID Nos: 242–272 and 274–384, and full-length or mature polypeptides encoded by the clone inserts of the deposited clone pool. By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% (5 of 100) of the amino acid residues in the subject sequence may be inserted, deleted, (indels) or substituted with another amino acid.

Further polypeptides of the present invention include polypeptides which have at least 90% similarity, more preferably at least 95% similarity, and still more preferably at least 96%, 97%, 98% or 99% similarity to those described above. By a polypeptide having an amino acid sequence at least, for example, 95% "similar" to a query amino acid sequence of the present invention, it is intended that the amino acid sequence of the subject polypeptide is similar (i.e. contain identical or equivalent amino acid residues) to the query sequence except that the subject polypeptide sequence may include up to five amino acid alterations per each 100 amino acids of the query amino acid sequence. In other words, to obtain a polypeptide having an amino acid sequence at least 95% similar to a query amino acid sequence, up to 5% (5 of 100) of the amino acid residues in the subject sequence may be inserted, deleted, (indels) or substituted with another non-equivalent amino acid.

These alterations of the reference sequence may occur at the amino or carboxy terminal positions of the reference amino acid sequence or anywhere between those terminal positions, interspersed either individually among residues in the reference sequence or in one or more contiguous groups within the reference sequence. The query sequence may be an entire amino acid sequence selected from the group consisting of sequences of SEQ ID Nos: 242–482 and those encoded by the clone inserts of the deposited clone pool or any fragment specified as described herein.

The variant polypeptides described herein are included in the present invention regardless of whether they have their normal biological activity. This is because even where a particular polypeptide molecule does not have biological activity, one of skill in the art would still know how to use the polypeptide, for instance, as a vaccine or to generate antibodies. Other uses of the polypeptides of the present invention that do not have GENSET biological activity include, inter alia, as epitope tags, in epitope mapping, and as molecular weight markers on SDS-PAGE gels or on molecular sieve gel filtration columns using methods known to those of skill in the art. As described below, the polypeptides of the present invention can also be used to raise polyclonal and monoclonal antibodies, which are useful in assays for detecting GENSET protein expression or as agonists and antagonists capable of enhancing or inhibiting GENSET protein function. Further, such polypeptides can be used in the yeast two-hybrid system to "capture" GENSET protein binding proteins, which are also candidate agonists and antagonists according to the present invention (See, e.g. Fields et al. 1989), which disclosure is hereby incorporated by reference in its entirety.

Preparation of the Polypeptides of the Invention

The polypeptides of the present invention can be prepared in any suitable manner. Such polypeptides include isolated naturally occurring polypeptides, recombinantly produced polypeptides, synthetically produced polypeptides, or polypeptides produced by a combination of these methods. The polypeptides of the present invention are preferably provided in an isolated form, and may be partially or preferably substantially purified.

Consequently, the present invention also comprises methods of making the polypeptides of the invention, particularly polypeptides encoded by the cDNAs of SEQ ID Nos: 1–241, mature proteins encoded by fragments of SEQS ID Nos: 1–31 and 33–143, full-length and mature polypeptides encoded by the clone inserts of the deposited clone pool, genomic DNA obtainable therefrom, or fragments thereof and methods of making the polypeptides of SEQ ID Nos: 242–482, mature polypeptides included in SEQ ID Nos: 242–272 and 274–384, or fragments thereof. The methods comprise sequentially linking together amino acids to produce the nucleic polypeptides having the preceding sequences. In some embodiments, the polypeptides made by these methods are 150 amino acids or less in length. In other embodiments, the polypeptides made by these methods are 120 amino acids or less in length.

Isolation

From Natural Sources

The GENSET proteins of the invention may be isolated from natural sources, including bodily fluids, tissues and cells, whether directly isolated or cultured cells, of humans or non-human animals. Methods for extracting and purifying natural proteins are known in the art, and include the use of detergents or chaotropic agents to disrupt particles followed by differential extraction and separation of the polypeptides by ion exchange chromatography, affinity chromatography, sedimentation according to density, and gel electrophoresis. See, for example, "Methods in Enzymology, Academic Press, 1993" for a variety of methods for purifying proteins, which disclosure is hereby incorporated by reference in its entirety. Polypeptides of the invention also can be purified from natural sources using antibodies directed against the polypeptides of the invention, such as those described herein, in methods which are well known in the art of protein purification.

From Recombinant Sources

Preferably, the GENSET polypeptides of the invention are recombinantly produced using routine expression methods known in the art. The polynucleotide encoding the desired polypeptide is operably linked to a promoter into an expression vector suitable for any convenient host. Both eukaryotic and prokaryotic host systems are used in forming recombinant polypeptides. The polypeptide is then isolated from lysed cells or from the culture medium and purified to the extent needed for its intended use.

Any GENSET polynucleotide, including those described in SEQ ID Nos: 1–241, those of clone inserts of the deposited clone pool, and allelic variants thereof may be used to express GENSET polypeptides. The nucleic acid encoding the GENSET polypeptide to be expressed is operably linked to a promoter in an expression vector using conventional cloning technology. The GENSET insert in the expression vector may comprise the full coding sequence for the GENSET protein or a portion thereof, especially the sequence for a mature polypeptide. For example, the GENSET derived insert may encode a polypeptide comprising at least 6, 8, 10, 12, 15, 20, 25, 30, 35, 40, 50, 60, 75, 100, 150 or 200 consecutive amino acids of a GENSET protein selected from the group consisting of sequences of SEQ ID Nos: 242–482 and polypeptides encoded by the clone inserts of the deposited clone pool.

Consequently, a further embodiment of the present invention is a method of making a polypeptide comprising a protein selected from the group consisting of sequences of SEQ ID Nos: 242–482 and polypeptides encoded by the clone inserts of the deposited clone pool, said method comprising the steps of a) obtaining a cDNA comprising a sequence selected from the group consisting of i) the sequences SEQ ID Nos: 1–241, ii) the sequences of clone inserts of the deposited clone pool one, iii) sequences encoding one of the polypeptide of SEQ ID Nos: 242–482, and iv) sequences of polynucleotides encoding a polypeptide which is encoded by one of the clone insert of the deposited clone pool;

b) inserting said cDNA in an expression vector such that the cDNA is operably linked to a promoter; and c) introducing said expression vector into a host cell whereby said host cell produces said polypeptide.

In one aspect of this embodiment, the method further comprises the step of isolating the polypeptide. Another embodiment of the present invention is a polypeptide obtainable by the method described in the preceding paragraph.

The expression vector is any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained in U.S. Pat. No. 5,082,767, which disclosure is hereby incorporated by reference in its entirety.

In one embodiment, the entire coding sequence of a GENSET cDNA and the 3'UTR through the poly A signal of the cDNA is operably linked to a promoter in the expression vector. Alternatively, if the nucleic acid encoding a portion of the GENSET protein lacks a methionine to serve as the initiation site, an initiating methionine can be introduced next to the first codon of the nucleic acid using conventional techniques. Similarly, if the insert from the GENSET cDNA lacks a poly A signal, this sequence can be added to the construct by, for example, splicing out the Poly A signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The nucleic acid encoding the GENSET protein or a portion thereof is obtained by PCR from a vector containing a GENSET cDNA selected from the group consisting of the sequences of SEQ ID Nos: 1–241 and the clone inserts of the deposited clone pool using oligonucleotide primers complementary to the GENSET cDNA or portion thereof and containing restriction endonuclease sequences for Pst I incorporated into the 5' primer and BglII at the 5' end of the corresponding cDNA 3' primer, taking care to ensure that the sequence encoding the GENSET protein or a portion thereof is positioned properly with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

Alternatively, cDNAs encoding secreted proteins may be cloned into pED6dpc2 (DiscoverEase, Genetics Institute, Cambridge, Mass.). The resulting pED6dpc2 constructs may be transfected into a suitable host cell, such as COS 1 cells. Methotrexate resistant cells are selected and expanded. Preferably, the secreted protein expressed from the cDNA is released into the culture medium thereby facilitating purification.

In another embodiment, it is often advantageous to add to the recombinant polynucleotide additional nucleotide sequence which codes for secretory or leader sequences, pro-sequences, sequences which aid in purification, such as multiple histidine residues, or an additional sequence for stability during recombinant production.

As a control, the expression vector lacking a cDNA insert is introduced into host cells or organisms.

Transfection of a GENSET expressing vector into mouse NTH 3T3 cells is but one embodiment of introducing polynucleotides into host cells. Introduction of a polynucleotide encoding a polypeptide into a host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al. (1986), which disclosure is hereby incorporated by reference in its entirety. It is specifically contemplated that the polypeptides of the present invention may in fact be expressed by a host cell lacking a recombinant vector.

Recombinant cell extracts, or proteins from the culture medium if the expressed polypeptide is secreted, are then prepared and proteins separated by gel electrophoresis. If desired, the proteins may be ammonium sulfate precipitated or separated based on size or charge prior to electrophoresis. The proteins present are detected using techniques such as Coomassie or silver staining or using antibodies against the protein encoded by the GENSET cDNA of interest. Coomassie and silver staining techniques are familiar to those skilled in the art.

Proteins from the host cells or organisms containing an expression vector which contains the GENSET cDNA or a fragment thereof are compared to those from the control cells or organism. The presence of a band from the cells containing the expression vector which is absent in control cells indicates that the GENSET cDNA is expressed. Generally, the band corresponding to the protein encoded by the GENSET cDNA will have a mobility near that expected based on the number of amino acids in the open reading frame of the cDNA. However, the band may have a mobility different than that expected as a result of modifications such as glycosylation, ubiquitination, or enzymatic cleavage.

Alternatively, the GENSET polypeptide to be expressed may also be a product of transgenic animals, i.e., as a component of the milk of transgenic cows, goats, pigs or sheeps which are characterized by somatic or germ cells containing a nucleotide sequence encoding the protein of interest.

A polypeptide of this invention can be recovered and purified from recombinant cell cultures by well-known methods including differential extraction, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. See, for example, "Methods in Enzymology", supra for a variety of methods for purifying proteins. Most preferably, high performance liquid chromatography ("HPLC") is employed for purification. A recombinantly produced version of a GENSET polypeptide can be substantially purified using techniques described herein or otherwise known in the art, such as, for example, by the one-step method described in Smith and Johnson (1988), which disclosure is hereby incorporated by reference in its entirety. Polypeptides of the invention also can be purified from recombinant sources using antibodies directed against the polypeptides of the invention, such as those described herein, in methods which are well known in the art of protein purification.

Preferably, the recombinantly expressed GENSET polypeptide is purified using standard immunochromatography techniques such as the one described in the section entitled "Immunoaffinity Chromatography". In such procedures, a solution containing the protein of interest, such as the culture medium or a cell extract, is applied to a column having antibodies against the protein attached to the chromatography matrix. The recombinant protein is allowed to bind the immunochromatography column. Thereafter, the column is washed to remove non-specifically bound proteins. The specifically bound protein is then released from the column and recovered using standard techniques.

If antibody production is not possible, the GENSET cDNA sequence or fragment thereof may be incorporated into expression vectors designed for use in purification schemes employing chimeric polypeptides. In such strategies the coding sequence of the GENSET cDNA or fragment thereof is inserted in frame with the gene encoding the other half of the chimera. The other half of the chimera may be beta-globin or a nickel binding polypeptide encoding sequence. A chromatography matrix having antibody to beta-globin or nickel attached thereto is then used to purify the chimeric protein. Protease cleavage sites may be engineered between the beta-globin gene or the nickel binding polypeptide and the GENSET cDNA or fragment thereof. Thus, the two polypeptides of the chimera may be separated from one another by protease digestion.

One useful expression vector for generating beta-globin chimerics is pSG5 (Stratagene), which encodes rabbit beta-globin. Intron II of the rabbit beta-globin gene facilitates splicing of the expressed transcript, and the polyadenylation signal incorporated into the construct increases the level of expression. These techniques as described are well known to those skilled in the art of molecular biology. Standard methods are published in methods texts such as Davis et al., (1986) and many of the methods are available from Stratagene, Life Technologies, Inc., or Promega. Polypeptide may additionally be produced from the construct using in vitro translation systems such as the In vitro Express™ Translation Kit (Stratagene).

Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

From Chemical Synthesis

In addition, polypeptides of the invention, especially short protein fragments, can be chemically synthesized using techniques known in the art (See, e.g., Creighton, 1983; and Hunkapiller et al., 1984), which disclosures are hereby incorporated by reference in their entireties. For example, a polypeptide corresponding to a fragment of a polypeptide sequence of the invention can be synthesized by use of a peptide synthesizer. A variety of methods of making polypeptides are known to those skilled in the art, including methods in which the carboxyl terminal amino acid is bound to polyvinyl benzene or another suitable resin. The amino acid to be added possesses blocking groups on its amino moiety and any side chain reactive groups so that only its carboxyl moiety can react. The carboxyl group is activated with carbodiimide or another activating agent and allowed to couple to the immobilized amino acid. After removal of the blocking group, the cycle is repeated to generate a polypeptide having the desired sequence. Alternatively, the methods described in U.S. Pat. No. 5,049,656, which disclosure is hereby incorporated by reference in its entirety, may be used.

Furthermore, if desired, nonclassical amino acids or chemical amino acid analogs can be introduced as a substitution or addition into the polypeptide sequence. Nonclassical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoroamino acids, designer amino acids such as b-methyl amino acids, Ca-methyl amino acids, Na-methyl amino acids, and amino acid analogs in general. Furthermore, the amino acid can be D (dextrorotary) or L (levorotary).

Modifications

The invention encompasses polypeptides which are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, NaBH4, acetylation, formylation, oxidation, reduction; metabolic synthesis in the presence of tunicamycin; etc.

Additional post-translational modifications encompassed by the invention include, for example, e.g., N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of prokaryotic host cell expression. The polypeptides may also be modified with a detectable label, such as an enzymatic, fluorescent, isotopic or affinity label to allow for detection and isolation of the protein.

Also provided by the invention are chemically modified derivatives of the polypeptides of the invention which may provide additional advantages such as increased solubility, stability and circulating time of the polypeptide, or decreased immunogenicity. See U.S. Pat. No. 4,179,337. The chemical moieties for derivatization may be selected See U.S. Pat. No. 4,179,337, which disclosure is hereby incorporated by reference in its entirety. The chemical moieties for derivatization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog).

The polyethylene glycol molecules (or other chemical moieties) should be attached to the protein with consideration of effects on functional or antigenic domains of the protein. There are a number of attachment methods available to those skilled in the art, e.g., EP 0 401 384, (coupling PEG to G-CSF), and Malik et al. (1992) (reporting pegylation of GM-CSF using tresyl chloride), which disclosures are hereby incorporated by reference in their entireties. For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

One may specifically desire proteins chemically modified at the N-terminus. Using polyethylene glycol as an illustration of the present composition, one may select from a variety of polyethylene glycol molecules (by molecular weight, branching, etc.), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus modification may be accomplished by reductive alkylation, which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

Multimerization

The polypeptides of the invention may be in monomers or multimers (i.e., dimers, trimers, tetramers and higher multimers). Accordingly, the present invention relates to monomers and multimers of the polypeptides of the invention, their preparation, and compositions containing them. In specific embodiments, the polypeptides of the invention are monomers, dimers, trimers or tetramers. In additional embodiments, the multimers of the invention are at least dimers, at least trimers, or at least tetramers.

Multimers encompassed by the invention may be homomers or heteromers. As used herein, the term "homomer", refers to a multimer containing only polypeptides corresponding to the amino acid sequences of SEQ ID Nos: 242–482 or encoded by the clone inserts of the deposited clone pool (including fragments, variants, splice variants, and fusion proteins, corresponding to these polypeptides as described herein). These homomers may contain polypeptides having identical or different amino acid sequences. In a specific embodiment, a homomer of the invention is a multimer containing only polypeptides having an identical amino acid sequence. In another specific embodiment, a homomer of the invention is a multimer containing polypeptides having different amino acid sequences. In specific embodiments, the multimer of the invention is a homodimer (e.g., containing polypeptides having identical or different amino acid sequences) or a homotrimer (e.g., containing polypeptides having identical and/or different amino acid sequences). In additional embodiments, the homomenc multimer of the invention is at least a homodimer, at least a homotrimer, or at least a homotetramer.

As used herein, the term "heteromer" refers to a multimer containing one or more heterologous polypeptides (i.e., polypeptides of different proteins) in addition to the polypeptides of the invention. In a specific embodiment, the multimer of the invention is a heterodimer, a heterotrimer, or a heterotetramer. In additional embodiments, the heteromeric multimer of the invention is at least a heterodimer, at least a heterotrimer, or at least a heterotetramer.

Multimers of the invention may be the result of hydrophobic, hydrophilic, ionic and/or covalent associations and/or may be indirectly linked, by for example, liposome formation. Thus, in one embodiment, multimers of the invention, such as, for example, homodimers or homotrimers, are formed when polypeptides of the invention contact one another in solution. In another embodiment, heteromultimers of the invention, such as, for example, heterotrimers or heterotetramers, are formed when polypeptides of the invention contact antibodies to the polypeptides of the invention (including antibodies to the heterologous polypeptide sequence in a fusion protein of the invention) in solution. In other embodiments, multimers of the invention are formed by covalent associations with and/or between the polypeptides of the invention. Such covalent associations may involve one or more amino acid residues contained in the polypeptide sequence (e.g., that recited in the sequence listing, or contained in the polypeptide encoded by a deposited clone). In one instance, the covalent associations are cross-linking between cysteine residues located within the polypeptide sequences, which interact in the native (i.e., naturally occurring) polypeptide. In another instance, the covalent associations are the consequence of chemical or recombinant manipulation. Alternatively, such covalent associations may involve one or more amino acid residues contained in the heterologous polypeptide sequence in a fusion protein of the invention.

In one example, covalent associations are between the heterologous sequence contained in a fusion protein of the invention (see, e.g., U.S. Pat. No. 5,478,925, which disclosure is hereby incorporated by reference in its entirety). In a specific example, the covalent associations are between the heterologous sequence contained in an Fc fusion protein of the invention (as described herein). In another specific example, covalent associations of fusion proteins of the invention are between heterologous polypeptide sequence from another protein that is capable of forming covalently associated multimers, such as for example, oseteoprotegerin (see, e.g., International Publication No: WO 98/49305, the contents of which are herein incorporated by reference in its entirety). In another embodiment, two or more polypeptides of the invention are joined through peptide linkers. Examples include those peptide linkers described in U.S. Pat. No. 5,073,627 (hereby incorporated by reference). Proteins comprising multiple polypeptides of the invention separated by peptide linkers may be produced using conventional recombinant DNA technology.

Another method for preparing multimer polypeptides of the invention involves use of polypeptides of the invention fused to a leucine zipper or isoleucine zipper polypeptide sequence. Leucine zipper and isoleucine zipper domains are polypeptides that promote multimerization of the proteins in which they are found. Leucine zippers were originally identified in several DNA-binding proteins, and have since been found in a variety of different proteins (Landschulz et al., 1988). Among the known leucine zippers are naturally occurring peptides and derivatives thereof that dimerize or trimerize. Examples of leucine zipper domains suitable for producing soluble multimeric proteins of the invention are those described in PCT application WO 94/10308, hereby incorporated by reference. Recombinant fusion proteins comprising a polypeptide of the invention fused to a polypeptide sequence that dimerizes or trimerizes in solution are expressed in suitable host cells, and the resulting soluble multimeric fusion protein is recovered from the culture supernatant using techniques known in the art.

Trimeric polypeptides of the invention may offer the advantage of enhanced biological activity. Preferred leucine zipper moieties and isoleucine moieties are those that preferentially form trimers. One example is a leucine zipper derived from lung surfactant protein D (SPD), as described in Hoppe et al. (1994) and in U.S. patent application Ser. No. 08/446,922, which disclosure is hereby incorporated by reference in its entirety. Other peptides derived from naturally occurring trimeric proteins may be employed in preparing trimeric polypeptides of the invention. In another example, proteins of the invention are associated by interactions between Flag® polypeptide sequence contained in fusion proteins of the invention containing Flag® polypeptide sequence. In a further embodiment, associations proteins of the invention are associated by interactions between heterologous polypeptide sequence contained in Flag® fusion proteins of the invention and anti Flag® antibody.

The multimers of the invention may be generated using chemical techniques known in the art. For example, polypeptides desired to be contained in the multimers of the invention may be chemically cross-linked using linker molecules and linker molecule length optimization techniques known in the art (see, e.g., U.S. Pat. No. 5,478,925, which is herein incorporated by reference in its entirety). Additionally, multimers of the invention may be generated using techniques known in the art to form one or more inter-molecule cross-links between the cysteine residues located within the sequence of the polypeptides desired to be contained in the multimer (see, e.g., U.S. Pat. No. 5,478,925, which is herein incorporated by reference in its entirety). Further, polypeptides of the invention may be routinely modified by the addition of cysteine or biotin to the C terminus or N-terminus of the polypeptide and techniques known in the art may be applied to generate multimers containing one or more of these modified polypeptides (see, e.g., U.S. Pat. No. 5,478,925, which is herein incorporated by reference in its entirety). Additionally, 30 techniques known in the art may be applied to generate liposomes containing the polypeptide components desired to be contained in the multimer of the invention (see, e.g., U.S. Pat. No. 5,478,925, which is herein incorporated by reference in its entirety).

Alternatively, multimers of the invention may be generated using genetic engineering techniques known in the art. In one embodiment, polypeptides contained in multimers of the invention are produced recombinantly using fusion protein technology described herein or otherwise known in the art (see, e.g., U.S. Pat. No. 5,478,925, which is herein incorporated by reference in its entirety). In a specific embodiment, polynucleotides coding for a homodimer of the invention are generated by ligating a polynucleotide sequence encoding a polypeptide of the invention to a sequence encoding a linker polypeptide and then further to a synthetic polynucleotide encoding the translated product of the polypeptide in the reverse orientation from the original C-terminus to the N-terminus (lacking the leader sequence) (see, e.g., U.S. Pat. No. 5,478,925, which is herein incorporated by reference in its entirety). In another embodiment, recombinant techniques described herein or otherwise known in the art are applied to generate recombinant polypeptides of the invention which contain a transmembrane domain (or hydrophobic or signal peptide) and which can be incorporated by membrane reconstitution techniques into liposomes (see, e.g., U.S. Pat. No. 5,478,925, which is herein incorporated by reference in its entirety).

Mutated Polypeptides

To improve or alter the characteristics of GENSET polypeptides of the present invention, protein engineering may be employed. Recombinant DNA technology known to those skilled in the art can be used to create novel mutant proteins or muteins including single or multiple amino acid substitutions, deletions, additions, or fusion proteins. Such modified polypeptides can show, e.g., increased/decreased biological activity or increased/decreased stability. In addition, they may be purified in higher yields and show better solubility than the corresponding natural polypeptide, at least under certain purification and storage conditions. Further, the polypeptides of the present invention may be produced as multimers including dimers, trimers and tetramers. Multimerization may be facilitated by linkers or recombinantly though heterologous polypeptides such as Fc regions.

N- and C-Terminal Deletions

It is known in the art that one or more amino acids may be deleted from the N-terminus or C-terminus without substantial loss of biological function. For instance, Ron et al. (1993), reported modified KGF proteins that had heparin binding activity even if 3, 8, or 27 N-terminal amino acid residues were missing. Accordingly, the present invention provides polypeptides having one or more residues deleted from the amino terminus of the polypeptides of SEQ ID Nos: 242–482 or that encoded by the clone inserts of the deposited clone pool. Similarly, many examples of biologically functional C-terminal deletion mutants are known. For instance, Interferon gamma shows up to ten times higher activities by deleting 810 amino acid residues from the C-terminus of the protein (See, e.g., Dobeli, et al. 1988), which disclosure is hereby incorporated by reference in its entirety. Accordingly, the present invention provides polypeptides having one or more residues deleted from the carboxy terminus of the polypeptides shown of SEQ ID Nos: 242–482 or encoded by the clone inserts of the deposited clone pool. The invention also provides polypeptides having one or more amino acids deleted from both the amino and the carboxyl termini as described below.

Other Mutations

Other mutants in addition to N- and C-terminal deletion forms of the protein discussed above are included in the present invention. It also will be recognized by one of ordinary skill in the art that some amino acid sequences of the GENSET polypeptides of the present invention can be varied without significant effect of the structure or function of the protein. If such differences in sequence are contemplated, it should be remembered that there will be critical areas on the protein which determine activity. Thus, the invention further includes variations of the GENSET polypeptides which show substantial GENSET polypeptide activity. Such mutants include deletions, insertions, inversions, repeats, and substitutions selected according to general rules known in the art so as to have little effect on activity. For example, guidance concerning how to make phenotypically silent amino acid substitutions is provided.

There are two main approaches for studying the tolerance of an amino acid sequence to change (See, Bowie et al. 1994), which disclosure is hereby incorporated by reference in its entirety. The first method relies on the process of evolution, in which mutations are either accepted or rejected by natural selection.

The second approach uses genetic engineering to introduce amino acid changes at specific positions of a cloned gene and selections or screens to identify sequences that maintain functionality. These studies have revealed that proteins are surprisingly tolerant of amino acid substitutions. The studies indicate which amino acid changes are likely to be permissive at a certain position of the protein. For example, most buried amino acid residues require nonpolar side chains, whereas few features of surface side chains are generally conserved. Other such phenotypically silent substitutions are described by Bowie et al. (supra) and the references cited therein.

Typically seen as conservative substitutions are the replacements, one for another, among the aliphatic amino acids Ala, Val, Leu and Phe; interchange of the hydroxyl residues Ser and Thr, exchange of the acidic residues Asp and Glu, substitution between the amide residues Asn and Gln, exchange of the basic residues Lys and Arg and replacements among the aromatic residues Phe, Tyr. Thus, the fragment, derivative, analog, or homologue of the polypeptide of the present invention may be, for example: (i) one in which one or more of the amino acid residues are substituted with a conserved or non-conserved amino acid residue (preferably a conserved amino acid residue) and such substituted amino acid residue may or may not be one encoded by the genetic code: or (ii) one in which one or more of the amino acid residues includes a substituent group: or (iii) one in which the GENSET polypeptide is fused with another compound, such as a compound to increase the half-life of the polypeptide (for example, polyethylene glycol): or (iv) one in which the additional amino acids are fused to the above form of the polypeptide, such as an IgG Fc fusion region peptide or leader or secretory sequence or a sequence which is employed for purification of the above form of the polypeptide or a pro-protein sequence. Such fragments, derivatives and analogs are deemed to be within the scope of those skilled in the art from the teachings herein.

Thus, the GENSET polypeptides of the present invention may include one or more amino acid substitutions, deletions, or additions, either from natural mutations or human manipulation. As indicated, changes are preferably of a minor nature, such as conservative amino acid substitutions that do not significantly affect the folding or activity of the protein. The following groups of amino acids generally represent equivalent changes: (1) Ala, Pro, Gly, Glu, Asp, Gln, Asn, Ser, Thr; (2) Cys, Ser, Tyr, Thr; (3) Val, Ile, Leu, Met, Ala, Phe; (4) Lys, Arg, His; (5) Phe, Tyr, Trp, His.

A specific embodiment of a modified GENSET peptide molecule of interest according to the present invention, includes, but is not limited to, a peptide molecule which is resistant to proteolysis, is a peptide in which the —CONH— peptide bond is modified and replaced by a (CH2NH) reduced bond, a (NHCO) retro inverso bond, a (CH2-O) methylene-oxy bond, a (CH2-S) thiomethylene bond, a (CH2CH2) carba bond, a (CO—CH2) cetomethylene bond, a (CHOH—CH2) hydroxyethylene bond), a (N—N) bound, a E-alcene bond or also a —CH=CH— bond. The invention also encompasses a human GENSET polypeptide or a fragment or a variant thereof in which at least one peptide bond has been modified as described above.

Amino acids in the GENSET proteins of the present invention that are essential for function can be identified by methods known in the art, such as site-directed mutagenesis or alanine-scanning mutagenesis (See, e.g., Cunningham et al. 1989), which disclosure is hereby incorporated by reference in its entirety. The latter procedure introduces single alanine mutations at every residue in the molecule. The resulting mutant molecules are then tested for biological activity using assays appropriate for measuring the function of the particular protein. Of special interest are substitutions of charged amino acids with other charged or neutral amino acids which may produce proteins with highly desirable improved characteristics, such as less aggregation. Aggregation may not only reduce activity but also be problematic when preparing pharmaceutical formulations, because aggregates can be immunogenic, (See, e.g., Pinckard et al., 1967; Robbins, et al., 1987; and Cleland, et al., 1993).

A further embodiment of the invention relates to a polypeptide which comprises the amino acid sequence of a GENSET polypeptide having an amino acid sequence which contains at least one conservative amino acid substitution, but not more than 50 conservative amino acid substitutions, not more than 40 conservative amino acid substitutions, not more than 30 conservative amino acid substitutions, and not more than 20 conservative amino acid substitutions. Also provided are polypeptides which comprise the amino acid sequence of a GENSET polypeptide, having at least one, but not more than 10, 9, 8, 7, 6, 5, 4, 3, 2 or 1 conservative amino acid substitutions.

Polypeptide Fragments

Structural Definition

The present invention is further directed to fragments of the amino acid sequences described herein such as the polypeptides of SEQ ID Nos: 242–482, mature polypeptides included in SEQ ID Nos: 242–272 and 274–384, or full-length or mature polypeptides encoded by the clone inserts of the deposited clone pool. More specifically, the present invention embodies purified, isolated, and recombinant polypeptides comprising at least 6, preferably at least 8 to 10, more preferably 12, 15, 20, 25, 30, 35, 40, 50, 60, 75, 100, 125, 150, 175, 200, 225, 250, 275, 300, 350, 400, 450 or 500 consecutive amino acids of a polypeptide selected from the group consisting of the sequences of SEQ ID Nos: 242–482, mature polypeptides included in SEQ ID Nos: 242–272 and 274–384, and full-length or mature polypeptides encoded by the clone inserts of the deposited clone pool, and other polypeptides of the present invention.

In addition to the above polypeptide fragments, further preferred sub-genuses of polypeptides comprise at least 6 amino acids, wherein "at least 6" is defined as any integer between 6 and the integer representing the C-terminal amino acid of the polypeptide of the present invention including the polypeptide sequences of the sequence listing below. Further included are species of polypeptide fragments at least 6 amino acids in length, as described above, that are further specified in terms of their N-terminal and C-terminal positions. However, included in the present invention as individual species are all polypeptide fragments, at least 6 amino acids in length, as described above, and may be particularly specified by a N-terminal and C-terminal position. That is, every combination of a N-terminal and C-terminal position that a fragment at least 6 contiguous amino acid residues in length could occupy, on any given amino acid sequence of the sequence listing or of the present invention is included in the present invention The present invention also provides for the exclusion of any fragment species specified by N-terminal and C-terminal positions or of any fragment sub-genus specified by size in amino acid residues as described above. Any number of fragments specified by N-terminal and C-terminal positions or by size in amino acid residues as described above may be excluded as individual species.

The above polypeptide fragments of the present invention can be immediately envisaged using the above description and are therefore not individually listed solely for the purpose of not unnecessarily lengthening the specification. Moreover, the above fragments need not have a GENSET biological activity, although polypeptides having these activities are preferred embodiments of the invention, since they would be useful, for example, in immunoassays, in epitope mapping, epitope tagging, as vaccines, and as molecular weight markers. The above fragments may also be used to generate antibodies to a particular portion of the polypeptide. These antibodies can then be used in immunoassays well known in the art to distinguish between human and non-human cells and tissues or to determine whether cells or tissues in a biological sample are or are not of the same type which express the polypeptides of the present invention.

It is noted that the above species of polypeptide fragments of the present invention may alternatively be described by the formula "a to b"; where "a" equals the N-terminal most amino acid position and "b" equals the C-terminal most amino acid position of the polynucleotide; and further where "a" equals an integer between 1 and the number of amino acids of the polypeptide sequence of the present invention minus 6, and where "b" equals an integer between 7 and the number of amino acids of the polypeptide sequence of the present invention; and where "a" is an integer smaller then "b" by at least 6.

The present invention also provides for the exclusion of any species of polypeptide fragments of the present invention specified by 5' and 3' positions or sub-genuses of polypeptides specified by size in amino acids as described above. Any number of fragments specified by 5' and 3' positions or by size in amino acids, as described above, may be excluded. Specifically excluded from the invention are the polypeptide fragments encoded by the preferentially excluded polynucleotide fragments described in Table IV, and in Tables Va and Vb. Table IV and Tables Va and Vb provide for the exclusion of polypeptides, independently from each other, in addition to those described elsewhere in the specification and is therefore, not meant as limiting description.

Functional Definition

Preferred polypeptide fragments of the invention are isolated, purified or recombinant polypeptides comprising, consisting of, or consisting essentially of signal peptides, preferably signal peptides selected from the group consisting of SEQ ID Nos: 242–272 and 274–384, signal peptides encoded by sequences of SEQ ID Nos: 1–31 and 33–143 and those encoded by the clone inserts of the deposited clone pool. Such polypeptides fragments are useful to design secretion vectors as described elsewhere in the application.

Other preferred polypeptide fragments of the invention are isolated, purified or recombinant polypeptides comprising, consisting of, or consisting essentially of mature proteins, preferably mature proteins selected from the group consisting of SEQ ID Nos: 242–272 and 274–384, mature proteins encoded by sequences of SEQ ID Nos: 1–31 and 33–143 and those encoded by the clone inserts of the deposited clone pool.

Domains

Preferred polynucleotide fragments of the invention are domains of polypeptides of the invention. Such domains may eventually comprise linear or structural motifs and signatures including, but not limited to, leucine zippers, helix-turn-helix motifs, post-translational modification sites such as glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites. Such domains may present a particular biological activity such as DNA or RNA-binding, secretion of proteins, transcription regulation, enzymatic activity, substrate binding activity, etc . . .

A domain has a size generally comprised between 3 and 2000 amino acids. In preferred embodiment, domains comprise a number of amino acids that is any integer between 6 and 500. Domains may be synthesized using any methods known to those skilled in the art, including those disclosed herein, particularly in the section entitled "Preparation of the polypeptides of the invention". Methods for determining the amino acids which make up a domain with a particular biological activity include mutagenesis studies and assays to determine the biological activity to be tested.

Alternatively, the polypeptides of the invention may be scanned for motifs, domains and/or signatures in databases using any computer method known to those skilled in the art. Searchable databases include Prosite (Hofmann et al., 1999; Bucher and Bairoch 1994), Pfam (Sonnhammer et al., 1997; Henikoff et al., 2000; Bateman et al., 2000), Blocks (Henikoff et al., 2000), Print (Attwood et al., 1996), Prodom (Sonnhammer and Kahn, 1994; Corpet et al. 2000), Sbase (Pongor et al., 1993; Murvai et al., 2000), Smart (Schultz et al., 1998), Dali/FSSP (Holm and Sander, 1996, 1997 and 1999), HSSP (Sander and Schneider 1991), CATH (Orengo et al., 1997; Pearl et al., 2000), SCOP (Murzin et al., 1995; Lo Conte et al., 2000), COG (Tatusov et al., 1997 and 2000), specific family databases and derivatives thereof (Nevill-Manning et al., 1998; Yona et al., 1999; Attwood et al., 2000), each of which disclosures are hereby incorporated by reference in their entireties. For a review on available databases, see issue 1 of volume 28 of Nucleic Acid Research (2000), which disclosure is hereby incorporated by reference in its entirety.

The polypeptides of SEQ ID NOs: 242–482 were screened for the presence of known structural or functional motifs or for the presence of signatures, small amino acid sequences that are well conserved amongst the members of a protein family. The search was conducted on the Pfam 5.5 database using HMMER-2.1.1 (for info see Sonnhammer et Durbin, http:/www.sanger.ac.uk/Pfam/), on a Blocks Plus database containing Blocks version 12.0, Prints version 26.0, Pfam version 5.3, Prodom version 99.1, and Domo version 2.0 using emotif (for info see Nevill-Manning et al., PNAS, 95, 5865–5871, (1998), http://motif.stanford/edu/EMOTIF) and on the Prosite 16.0 database using bla (Tatusov, R. L. & Koonin, E. V. CABIOS 10, No. 4) and pfscan (http://www.isrec.isb.sib.ch/cgi-bin/man.cgi?section=1&topic=pfscan). Some of these predicted domains are described in Table VI. For these polypeptides referred to by their sequence identification numbers (column entitled "Seq Id No"), Table VI gives the designation of the domain (column entitled "Designation of domain") according to the database of domains indicated in the column entitled "Database " and the positions of preferred fragments within these sequences (column entitled "Positions of domains"). Each fragment is represented by a–b where a and b are the start and end positions respectively of a given preferred fragment on the full-length polypeptide. Preferred fragments are separated from each other by a coma. As used herein, the term "domain described in Table VI" refers to all the domains listed in Table VI for a given GENSET protein referred to by its sequence identification number in the first column. It should be noted that in Table VI, the first methionine encountered is designated as amino acid number 1, i.e;, the leader sequence is not numbered negatively. In the appended sequence listing, the first amino acid of the mature protein resulting from cleavage of the signal peptide is designated as amino acid number 1 and the first amino acid of the signal peptide is designated with the appropriate negative number, in accordance with the regulations governing sequence listings.

Consequently, preferred polynucleotide fragments of the invention are domains of the polypeptides of SEQ ID Nos: 242–482. Therefore, the present invention encompasses isolated, purified, or recombinant polypeptides which consist of, consist essentially of, or comprise a contiguous span of at least 6, preferably at least 8 to 10, more preferably 12, 15, 20, 25, 30, 35, 40, 50, 60, 75, 100, 125, 150, 175, 200, 225, 250, 275, 300, 350, 400, 450 or 500 amino acids of a sequence selected from the group consisting of the sequences of SEQ ID Nos: 242–482, to the extent that a contiguous span of these lengths is consistent with the lengths of said selected sequence, where said contiguous span comprises at least 1, 2, 3, 5, or 10 amino acids positions of a domain described in Table VI of said selected sequence. The present invention also encompasses isolated, purified, or recombinant polypeptides comprising, consisting essentially of, or consisting of a contiguous span of at least 6, preferably at least 8 to 10, more preferably 12, 15, 20, 25, 30, 35, 40, 50, 60, 75, 100, 125, 150, 175, 200, 225, 250, 275, 300, 350, 400, 450 or 500 amino acids of a sequence selected from the group consisting of the sequences of SEQ ID Nos: 242–482, to the extent that a contiguous span of these lengths is consistent with the lengths of said selected sequence, where said contiguous span is a domain described in Table VI of said selected sequence. The present invention also encompasses isolated, purified, or recombinant polypeptides which comprise, consist of or consist essentially of a domain described in Table VI of a sequence selected from the group consisting of the sequences of SEQ ID Nos: 242–482.

Polypeptides of the present invention that are not specifically described in this table are not considered as not belonging to a domain. This is because they may still be not recognized as such by the particular algorithms used or not be included in the particular database searched. In fact, all fragments of the polypeptides of the present invention, at least 6 amino acids residues in length, are included in the present invention as being a domain. Amino acid residues comprising other domains may be determined by looking in other databases than the ones currently cited to establish Table VI. The domains of the present invention preferably comprises 6 to 200 amino acids (i.e. any integer between 6 and 200, inclusive) of a polypeptide of the present invention. Also, included in the present invention are domain fragments between the integers of 6 and the full length GENSET sequence of the sequence listing. All combinations of sequences between the integers of 6 and the full-length sequence of a GENSET polypeptide are included. The domain fragments may be specified by either the number of contiguous amino acid residues (as a sub-genus) or by specific N-terminal and C-terminal positions (as species) as described above for the polypeptide fragments of the present invention. Any number of domain fragments of the present invention may also be excluded in the same manner.

Epitopes and Antibody Fusions:

A preferred embodiment of the present invention is directed to epitope-bearing polypeptides and epitope-bearing polypeptide fragments. These epitopes may be "antigenic epitopes" or both an "antigenic epitope" and an "immunogenic epitope". An "immunogenic epitope" is defined as a part of a protein that elicits an antibody response in vivo when the polypeptide is the immunogen. On the other hand, a region of polypeptide to which an antibody binds is defined as an "antigenic determinant" or "antigenic epitope." The number of immunogenic epitopes of a protein generally is less than the number of antigenic epitopes (See, e.g., Geysen, et al., 1984), which disclosure is hereby incorporated by reference in its entirety. It is particularly noted that although a particular epitope may not be immunogenic, it is nonetheless useful since antibodies can be made to both immunogenic and antigenic epitopes.

An epitope can comprise as few as 3 amino acids in a spatial conformation, which is unique to the epitope. Generally an epitope consists of at least 6 such amino acids, and more often at least 8–10 such amino acids. In preferred embodiment, antigenic epitopes comprise a number of amino acids that is any integer between 3 and 50. Fragments which function as epitopes may be produced by any conventional means (See, e.g., Houghten, 1985), also further described in U.S. Pat. No. 4,631,21, which disclosures are hereby incorporated by reference in their entireties. Methods for determining the amino acids which make up an epitope include x-ray crystallography, 2-dimensional nuclear magnetic resonance, and epitope mapping, e.g., the Pepscan method described by Geysen et al. (1984); PCT Publication No. WO 84/03564; and PCT Publication No. WO 84/03506, which disclosures are hereby incorporated by reference in their entireties. Another example is the algorithm of Jameson and Wolf, (1988) (said reference incorporated by reference in its entirety). The Jameson-Wolf antigenic analysis, for example, may be performed using the computer program PROTEAN, using default parameters (Version 4.0 Windows, DNASTAR, Inc., 1228 South Park Street Madison, Wis.

Antigenic epitopes predicted by the Jameson-Wolf algorithm for the polypeptides of SEQ ID Nos: 242–482 are presented in Table VII. For each GENSET polypeptide referred to by its sequence identification number in the column entitled "Seq Id No", a list of antigenic epitopes is given in the column entitled "Epitopes", each epitope being separated by a coma. Each fragment is represented by a-b where a and b are the start and end positions respectively of a given preferred fragment. It should be noted that in Table VII, the first methionine encountered is designated as amino acid number 1, i.e; the leader sequence is not numbered negatively. In the appended sequence listing, the first amino acid of the mature protein resulting from cleavage of the signal peptide is designated as amino acid number 1 and the first amino acid of the signal peptide is designated with the appropriate negative number, in accordance with the regulations governing sequence listings. As used herein, the term "epitope described in Table VII" refers to all preferred polynucleotide fragments described in the second column of Table VII for a GENSET polypeptide referred to by its sequence identification number in the first column. It is pointed out that the immunogenic epitopes listed in Table VII describe only amino acid residues comprising epitopes predicted to have the highest degree of immunogenicity by a particular algorithm. Polypeptides of the present invention that are not specifically described as immunogenic are not considered non-antigenic. This is because they may still be antigenic in vivo but merely not recognized as such by the particular algorithm used. Alternatively, the polypeptides are most likely antigenic in vitro using methods such a phage display. Thus, listed in Table VII are the amino acid residues comprising only preferred epitopes, not a complete list. In fact, all fragments of the polypeptides of the present invention, at least 6 amino acids residues in length, are included in the present invention as being useful as antigenic epitope. Amino acid residues comprising other immunogenic epitopes may be determined by algorithms similar to the Jameson-Wolf analysis or by in vivo testing for an antigenic response using the methods described herein or those known in the art.

Therefore, the present invention encompasses isolated, purified, or recombinant polypeptides which consist of, consist essentially of, or comprise a contiguous span of at least 6, preferably at least 8 to 10, more preferably 12, 15, 20, 25, 30, 35, 40, 50, 60, 75, 100, 125, 150, 175, 200, 225, 250, 275, 300, 350, 400, 450 or 500 amino acids of a sequence selected from the group consisting of the sequences of SEQ ID Nos: 242–482, to the extent that a contiguous span of these lengths is consistent with the lengths of said selected sequence, where said contiguous span comprises at least 1, 2, 3, 5, or 10 amino acids positions of an epitope described in Table VII of said selected sequence. The present invention also encompasses isolated, purified, or recombinant polypeptides comprising, consisting essentially of, or consisting of a contiguous span of at least 6, preferably at least 8 to 10, more preferably 12, 15, 20, 25, 30, 35, 40, 50, 60, 75, 100, 125, 150, 175, 200, 225, 250, 275, 300, 350, 400, 450 or 500 amino acids of a sequence selected from the group consisting of the sequences of SEQ ID Nos: 242–482, to the extent that a contiguous span of these lengths is consistent with the lengths of said selected sequence, where said contiguous span is an epitope described in Table VII of said selected sequence. The present invention also encompasses isolated, purified, or recombinant polypeptides which comprise, consist of or consist essentially of an epitope described in Table VII of a sequence selected from the group consisting of the sequences of SEQ ID Nos: 242–482.

The epitope-bearing fragments of the present invention preferably comprises 6 to 50 amino acids (i.e. any integer between 6 and 50, inclusive) of a polypeptide of the present invention. Also, included in the present invention are antigenic fragments between the integers of 6 and the full length GENSET sequence of the sequence listing. All combinations of sequences between the integers of 6 and the full-length sequence of a GENSET polypeptide are included. The epitope-bearing fragments may be specified by either the number of contiguous amino acid residues (as a sub-genus) or by specific N-terminal and C-terminal positions (as species) as described above for the polypeptide fragments of the present invention. Any number of epitope-bearing fragments of the present invention may also be excluded in the same manner.

Antigenic epitopes are useful, for example, to raise antibodies, including monoclonal antibodies that specifically bind the epitope (See, Wilson et al., 1984; and Sutcliffe, et al., 1983), which disclosures are hereby incorporated by reference in their entireties. The antibodies are then used in various techniques such as diagnostic and tissue/cell identification techniques, as described herein, and in purification methods such as immunoaffinity chromatography.

An antibody or other compound that specifically binds to a polypeptide or polynucleotide of the invention is also said to "selectively recognize" the polypeptide or polynucleotide.

Similarly, immunogenic epitopes can be used to induce antibodies according to methods well known in the art (See, Sutcliffe et al., supra; Wilson et al., supra; Chow et al.; (1985) and Bittle, et al., (1985), which disclosures are hereby incorporated by reference in their entireties). A preferred immunogenic epitope includes the natural GENSET protein. The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting.).

Epitope-bearing polypeptides of the present invention are used to induce antibodies according to methods well known in the art including, but not limited to, in vivo immunization, in vitro immunization, and phage display methods (See, e.g., Sutcliffe, et al., supra; Wilson, et al., supra, and Bittle, et al., supra). If in vivo immunization is used, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine residues may be coupled to a carrier using a linker such as -maleimidobenzoyl-N-hydroxysuccinimide ester (MBS), while other peptides may be coupled to carriers using a more general linking agent such as glutaraldehyde. Animals such as rabbits, rats and mice are immunized with either free or carrier-coupled peptides, for instance, by intraperitoneal and/or intradermal injection of emulsions containing about 100 μgs of peptide or carrier protein and Freund's adjuvant. Several booster injections may be needed, for instance, at intervals of about two weeks, to provide a useful titer of anti-peptide antibody, which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and discussed above, the polypeptides of the present invention comprising an immunogenic or antigenic epitope can be fused to heterologous polypeptide sequences. For example, the polypeptides of the present invention may be fused with the constant domain of immunoglobulins (IgA, IgE, IgG, IgM), or portions thereof (CH1, CH2, CH3, any combination thereof including both entire domains and portions thereof) resulting in chimeric polypeptides. These fusion proteins facilitate purification, and show an increased half-life in vivo. This has been shown, e.g., for chimeric proteins consisting of the first two domains of the human CD4-polypeptide and various domains of the constant regions of the heavy or light chains of mammalian immunoglobulins (See, e.g., EPA 0,394,827; and Traunecker et al., 1988), which disclosures are hereby incorporated by reference in their entireties. Fusion proteins that have a disulfide-linked dimeric structure due to the IgG portion can also be more efficient in binding and neutralizing other molecules than monomeric polypeptides or fragments thereof alone (See, e.g., Fountoulakis et al., 1995), which disclosure is hereby incorporated by reference in its entirety. Nucleic acids encoding the above epitopes can also be recombined with a gene of interest as an epitope tag to aid in detection and purification of the expressed polypeptide.

Additional fusion proteins of the invention may be generated through the techniques of gene-shuffling, motif-shuffling, exon-shuffling, or codon-shuffling (collectively referred to as "DNA shuffling"). DNA shuffling may be employed to modulate the activities of polypeptides of the present invention thereby effectively generating agonists and antagonists of the polypeptides. See, for example, U.S. Pat. Nos. 5,605,793; 5,811,238; 5,834,252; 5,837,458; and Patten, et al., (1997); Harayama, (1998); Hansson, et al (1999); and Lorenzo and Blasco, (1998). (Each of these documents are hereby incorporated by reference). In one embodiment, one or more components, motifs, sections, parts, domains, fragments, etc., of coding polynucleotides of the invention, or the polypeptides encoded thereby may be recombined with one or more components, motifs, sections, parts, domains, fragments, etc. of one or more heterologous molecules.

The present invention further encompasses any combination of the polypeptide fragments listed in this section.

Antibodies:
Definitions

The present invention further relates to antibodies and T-cell antigen receptors (TCR), which specifically bind the polypeptides, and more specifically, the epitopes of the polypeptides of the present invention. The antibodies of the present invention include IgG (including IgG1, IgG2, IgG3, and IgG4), IgA (including IgA1 and IgA2), IgD, IgE, or IgM, and IgY. The term "antibody" (Ab) refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen, which allows an immunological reaction with the antigen. As used herein, the term "antibody" is meant to include whole antibodies, including single-chain whole antibodies, and antigen binding fragments thereof. In a preferred embodiment the antibodies are human antigen binding antibody fragments of the present invention include, but are not limited to, Fab, Fab' F(ab)2 and F(ab')2, Fd, single-chain Fvs (scFv), single-chain antibodies, disulfide-linked Fvs (sdFv) and fragments comprising either a $V_L$ or $V_H$ domain. The antibodies may be from any animal origin including birds and mammals. Preferably, the antibodies are human, murine, rabbit, goat, guinea pig, camel, horse, or chicken.

Antigen-binding antibody fragments, including single-chain antibodies, may comprise the variable region(s) alone or in combination with the entire or partial of the following: hinge region, CH1, CH2, and CH3 domains. Also included in the invention are any combinations of variable region(s) and hinge region, CH1, CH2, and CH3 domains. The present invention further includes chimeric, humanized, and human monoclonal and polyclonal antibodies, which specifically bind the polypeptides of the present invention. The present invention further includes antibodies that are anti-idiotypic to the antibodies of the present invention.

The antibodies of the present invention may be monospecific, bispecific, and trispecific or have greater multispecificity. Multispecific antibodies may be specific for different epitopes of a polypeptide of the present invention or may be specific for both a polypeptide of the present invention as well as for heterologous compositions, such as a heterologous polypeptide or solid support material. See, e.g., WO 93/17715; WO 92/08802; WO 91/00360; WO 92/05793; Tutt, et al. (1991); U.S. Pat. Nos. 5,573,920, 4,474,893, 5,601,819, 4,714,681, 4,925,648; Kostelny et al. (1992), which disclosures are hereby incorporated by reference in their entireties.

Antibodies of the present invention may be described or specified in terms of the epitope(s) or epitope-bearing portion(s) of a polypeptide of the present invention, which are recognized or specifically bound by the antibody. The antibodies may specifically bind a complete protein encoded by a nucleic acid of the present invention, or a fragment thereof, particularly, in the case of secreted proteins the mature protein or the signal peptide. Therefore, the epitope(s) or epitope bearing polypeptide portion(s) may be specified as described herein, e.g., by N-terminal and C-terminal positions, by size in contiguous amino acid residues, or otherwise described herein (including the sequence listing). Antibodies which specifically bind any epitope or polypeptide of the present invention may also be excluded as individual species. Therefore, the present invention includes antibodies that specifically bind specified polypeptides of the present invention, and allows for the exclusion of the same.

Thus, another embodiment of the present invention is a purified or isolated antibody capable of specifically binding to a polypeptide comprising a sequence selected from the group consisting of the sequences of SEQ ID Nos: 242–482 and the sequences of the clone inserts of the deposited clone pool. In one aspect of this embodiment, the antibody is capable of binding to an epitope-containing polypeptide comprising at least 6 consecutive amino acids, preferably at least 8 to 10 consecutive amino acids, more preferably at least 12, 15, 20, 25, 30, 40, 50, or 100 consecutive amino acids of a sequence selected from the group consisting of SEQ ID Nos: 242–482 and sequences of the clone inserts of the deposited clone pool.

Antibodies of the present invention may also be described or specified in terms of their cross-reactivity. Antibodies that do not specifically bind any other analog, ortholog, or homologue of the polypeptides of the present invention are included. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein, e.g., using FASTDB and the parameters set forth herein) to a polypeptide of the present invention are also included in the present invention. Further included in the present invention are antibodies, which only bind polypeptides encoded by polynucleotides, which hybridize to a polynucleotide of the present invention under stringent hybridization conditions (as described herein). Antibodies of the present invention may also be described or specified in terms of their binding affinity. Preferred binding affinities include those with a dissociation constant or Kd less than $5\times10^{-6}$M, $10^{-6}$M, $5\times10^{-7}$M, $10^{-7}$M, $5\times10^{-8}$M, $10^{-8}$M, $5\times10^{-9}$M, $10^{-9}$M, $5\times10^{-10}$M, $10^{-10}$M, $5\times10^{-11}$M, $10^{-11}$M, $5\times10^{-12}$M, $10^{-12}$M, $5\times10^{-13}$M, $10^{-13}$M, $5\times10^{-14}$M, $10^{-14}$M, $5\times10^{-15}$M, and $10^{-15}$M.

The invention also concerns a purified or isolated antibody capable of specifically binding to a mutated GENSET protein or to a fragment or variant thereof comprising an epitope of the mutated GENSET protein.

Preparation of Antibodies

The antibodies of the present invention may be prepared by any suitable method known in the art. Some of these methods are described in more detail in the example entitled "Preparation of Antibody Compositions to". For example, a polypeptide of the present invention or an antigenic fragment thereof can be administered to an animal in order to induce the production of sera containing "polyclonal antibodies". As used herein, the term "monoclonal antibody" is not limited to antibodies produced through hybridoma technology but it rather refers to an antibody that is derived from a single clone, including eukaryotic, prokaryotic, or phage clone, and not the method by which it is produced. Monoclonal antibodies can be prepared using a wide variety of techniques known in the art including the use of hybridoma, recombinant, and phage display technology.

Hybridoma techniques include those known in the art (See, e.g., Hallow et al. 1988; Hammerling, et al, 1981). (Said references incorporated by reference in their entireties). Fab and F(ab')2 fragments may be produced, for example, from hybridoma-produced antibodies by proteolytic cleavage, using enzymes such as papain (to produce Fab fragments) or pepsin (to produce F(ab')2 fragments).

Alternatively, antibodies of the present invention can be produced through the application of recombinant DNA technology or through synthetic chemistry using methods known in the art. For example, the antibodies of the present invention can be prepared using various phage display methods known in the art. In phage display methods, functional antibody domains are displayed on the surface of a phage particle, which carries polynucleotide sequences encoding them. Phage with a desired binding property are selected from a repertoire or combinatorial antibody library (e.g. human or murine) by selecting directly with antigen, typically antigen bound or captured to a solid surface or bead. Phage used in these methods are typically filamentous phage including fd and M13 with Fab, Fv or disulfide stabilized Fv antibody domains recombinantly fused to either the phage gene III or gene VIII protein. Examples of phage display methods that can be used to make the antibodies of the present invention include those disclosed in Brinkman et al. (1995); Ames, et al. (1995); Kettleborough, et al. (1994); Persic, et al. (1997); Burton et al. (1994); PCT/GB91/01134; WO 90/02809; WO 91/10737; WO 92/01047; WO 92/18619; WO 93/11236; WO 95/15982; WO 95/20401; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727 and 5,733,743 (said references incorporated by reference in their entireties).

As described in the above references, after phage selection, the antibody coding regions from the phage can be isolated and used to generate whole antibodies, including human antibodies, or any other desired antigen binding fragment, and expressed in any desired host including mammalian cells, insect cells, plant cells, yeast, and bacteria. For example, techniques to recombinantly produce Fab, Fab' F(ab)2 and F(ab')2 fragments can also be employed using methods known in the art such as those disclosed in WO 92/22324; Mullinax et al. (1992); and Sawai et al. (1995); and Better et al. (1988) (said references incorporated by reference in their entireties).

Examples of techniques which can be used to produce single-chain Fvs and antibodies include those described in U.S. Pat. Nos. 4,946,778 and 5,258,498; Huston et al. (1991); Shu et al. (1993); and Skerra et al. (1988), which disclosures are hereby incorporated by reference in their entireties. For some uses, including in vivo use of antibodies in humans and in vitro detection assays, it may be preferable to use chimeric, humanized, or human antibodies. Methods for producing chimeric antibodies are known in the art. See e.g., Morrison, (1985); Oi et al., (1986); Gillies et al. (1989); and U.S. Pat. No. 5,807,715, which disclosures are hereby incorporated by reference in their entireties. Antibodies can be humanized using a variety of techniques including CDR-grafting (EP 0 239 400; WO 91/09967; U.S. Pat. Nos. 5,530,101; and 5,585,089), veneering or resurfacing, (EP 0 592 106; EP 0 519 596; Padlan, 1991; Studnicka et al., 1994; Roguska et al., 1994), and chain shuffling (U.S. Pat. No. 5,565,332), which disclosures are hereby incorporated by reference in their entireties. Human antibodies can be made by a variety of methods known in the art including phage display methods described above. See also, U.S. Pat. Nos. 4,444,887, 4,716,111, 5,545,806, and 5,814,318; WO 98/46645; WO 98/50433; WO 98/24893; WO 96/34096; WO 96/33735; and WO 91/10741 (said references incorporated by reference in their entireties).

Further included in the present invention are antibodies recombinantly fused or chemically conjugated (including both covalently and non-covalently conjugations) to a polypeptide of the present invention. The antibodies may be specific for antigens other than polypeptides of the present invention. For example, antibodies of the present invention may be recombinantly fused or conjugated to molecules useful as labels in detection assays and effector molecules such as heterologous polypeptides, drugs, or toxins. See, e.g., WO 92/08495; WO 91/14438; WO 89/12624; U.S. Pat. No. 5,314,995; and EP 0 396 387, which disclosures are hereby incorporated by reference in their entireties. Fused antibodies may also be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in vitro immunoassays and purification methods using methods known in the art (See e.g., Harbor et al. supra; WO 93/21232; EP 0 439 095; Naramura, M. et al. 1994; U.S. Pat. No. 5,474,981; Gillies et al., 1992; Fell et al., 1991) (said references incorporated by reference in their entireties).

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the hinge region, CH1 domain, CH2 domain, and CH3 domain or any combination of whole domains or portions thereof. The polypeptides of the present invention may be fused or conjugated to the above antibody portions to increase the in vivo half-life of the polypeptides or for use in immunoassays using methods known in the art. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See e.g., U.S. Pat. Nos. 5,336,603, 5,622,929, 5,359,046, 5,349,053, 5,447,851, 5,112,946; EP 0 307 434, EP 0 367 166; WO 96/04388, WO 91/06570; Ashkenazi et al. (1991); Zheng et al. (1995); and Vil et al. (1992) (said references incorporated by reference in their entireties).

Non-human animals or mammals, whether wild-type or transgenic, which express a different species of GENSET than the one to which antibody binding is desired, and animals which do not express GENSET (i.e. a GENSET knock out animal as described herein) are particularly useful for preparing antibodies. GENSET knock out animals will recognize all or most of the exposed regions of a GENSET protein as foreign antigens, and therefore produce antibodies with a wider array of GENSET epitopes. Moreover, smaller polypeptides with only 10 to 30 amino acids may be useful in obtaining specific binding to any one of the GENSET proteins. In addition, the humoral immune system of animals which produce a species of GENSET that resembles the antigenic sequence will preferentially recognize the differences between the animal's native GENSET species and the antigen sequence, and produce antibodies to these unique sites in the antigen sequence. Such a technique will be particularly useful in obtaining antibodies that specifically bind to any one of the GENSET proteins.

The antibodies of the invention may be labeled by any one of the radioactive, fluorescent or enzymatic labels known in the art.

Uses of Polynucleotides

Uses of Polynucleotides as Reagents

The polynucleotides of the present invention, particularly those described in the "Oligonucleotide primers and probes" section, may be used as reagents in isolation procedures, diagnostic assays, and forensic procedures. For example, sequences from the GENSET polynucleotides of the invention may be detectably labeled and used as probes to isolate other sequences capable of hybridizing to them. In addition, sequences from the GENSET polynucleotides of the invention may be used to design PCR primers to be used in isolation, diagnostic, or forensic procedures.

In Forensic Analyses

PCR primers may be used in forensic analyses, such as the DNA fingerprinting techniques described below. Such analyses may utilize detectable probes or primers based on the sequences of the polynucleotides of the invention. Consequently, the present invention encompasses methods of identification of an individual using the polynucleotides of the invention in forensic analyses, wherein said method includes the steps of:

a) obtaining a biological sample containing nucleic acid material from an individual;

b) obtaining an identification pattern for this individual using the polynucleotides of the invention, particularly using GENSET primers and probes;

c) comparing said identification pattern with a reference identification pattern; and d) determining whether said identification pattern is identical to said reference identification pattern.

In one embodiment of this method, the identification pattern consists in sequences of amplicons obtained using GENSET primers as explained in the sections entitled "Forensic Matching by DNA Sequencing" and "Positive Identification by DNA Sequencing".

In another embodiment, the identification pattern consists in unique band or dot patterns obtained using any method described in the sections entitled "Southern Blot Forensic Identification", "Dot Blot Identification Procedure" and "Alternative "Fingerprint" Identification Technique".

Forensic Matching by DNA Sequencing

In one exemplary method, DNA samples are isolated from forensic specimens of, for example, hair, semen, blood or skin cells by conventional methods. A panel of PCR primers designed from different polynucleotides of the invention using any technique known to those skilled in the art including those described herein, is then utilized to amplify DNA of approximately 100–200 bases in length from the forensic specimen. Corresponding sequences are obtained from a test subject. Each of these identification DNAs is then sequenced using standard techniques, and a simple database comparison determines the differences, if any, between the sequences from the subject and those from the sample. Statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 50 statistically identical sequences of 100 bases in length are used to prove identity between the suspect and the sample.

Positive Identification by DNA Sequencing

The "Forensic Matching by DNA Sequencing" technique described herein may also be used on a larger scale to provide a unique fingerprint-type identification of any individual. In this technique, primers are prepared from a large number of polynucleotides of the invention. Preferably, 20 to 50 different primers are used. These primers are used to obtain a corresponding number of PCR-generated DNA segments from the individual in question. Each of these DNA segments is sequenced. The database of sequences generated through this procedure uniquely identifies the individual from whom the sequences were obtained. The same panel of primers may then be used at any later time to absolutely correlate tissue or other biological specimen with that individual.

Southern Blot Forensic Identification

The "Positive Identification by DNA Sequencing" procedure described herein is repeated to obtain a panel of at least 10 amplified sequences from an individual and a specimen. Preferably, the panel contains at least 50 amplified sequences. More preferably, the panel contains 100 amplified sequences. In some embodiments, the panel contains 200 amplified sequences. This PCR-generated DNA is then digested with one or a combination of, preferably, four base specific restriction enzymes. Such enzymes are commercially available and known to those of skill in the art. After digestion, the resultant gene fragments are size separated in multiple duplicate wells on an agarose gel and transferred to nitrocellulose using Southern blotting techniques well known to those with skill in the art. For a review of Southern blotting see Davis et al. (1986), which disclosure is hereby incorporated by reference in its entirety.

A panel of probes based on the sequences of the polynucleotides of the invention, or fragments thereof of at least 10 bases, are radioactively or calorimetrically labeled using methods known in the art, such as nick translation or end labeling, and hybridized to the Southern blot using techniques known in the art. Preferably, the probe comprises at least 12, 15, or 17 consecutive nucleotides from the polynucleotide of the invention. More preferably, the probe comprises at least 20–30 consecutive nucleotides from the polynucleotide of the invention. In some embodiments, the probe comprises more than 30 nucleotides from the polynucleotide of the invention. In other embodiments, the probe comprises at least 40, at least 50, at least 75, at least 100, at least 150, or at least 200 consecutive nucleotides from the polynucleotide of the invention.

Preferably, at least 5 to 10 of these labeled probes are used, and more preferably at least about 20 or 30 are used to provide a unique pattern. The resultant bands appearing from the hybridization of a large sample of polynucleotide of the invention will be a unique identifier. Since the restriction enzyme cleavage will be different for every individual, the band pattern on the Southern blot will also be unique. Increasing the number of cDNA probes will provide a statistically higher level of confidence in the identification since there will be an increased number of sets of bands used for identification.

Dot Blot Identification Procedure

Another technique for identifying individuals using the polynucleotide sequences disclosed herein utilizes a dot blot hybridization technique.

Genomic DNA is isolated from nuclei of subject to be identified. Oligonucleotide probes of approximately 30 bp in length are synthesized that correspond to at least 10, preferably 50 sequences from the polynucleotide of the invention. The probes are used to hybridize to the genomic DNA through conditions known to those in the art. The oligonucleotides are end labeled with $P^{32}$ using polynucleotide kinase (Pharmacia). Dot Blots are created by spotting the genomic DNA onto nitrocellulose or the like using a vacuum dot blot manifold (BioRad, Richmond Calif.). The nitrocellulose filter containing the genomic sequences is baked or UV linked to the filter, prehybridized and hybridized with labeled probe using techniques known in the art (Davis et al. 1986). The $^{32}P$ labeled DNA fragments are sequentially hybridized with successively stringent conditions to detect minimal differences between the 30 bp sequence and the DNA. Tetramethylammonium chloride is useful for identifying clones containing small numbers of nucleotide mismatches (Wood et al., 1985). A unique pattern of dots distinguishes one individual from another individual.

Alternative "Fingerprint" Identification Technique

In a representative alternative fingerprinting procedure, the probes are derived from cDNAs. Preferably, a plurality of probes having sequences from different genes are used as follows. Polynucleotides containing at least 10 consecutive bases from these sequences can be used as probes. Preferably, the probe comprises at least 12, 15, or 17 consecutive nucleotides from the polynucleotide of the invention. More preferably, the probe comprises at least 20–30 consecutive nucleotides from the polynucleotide of the invention. In some embodiments, the probe comprises more than 30 nucleotides from the polynucleotide of the invention. In other embodiments, the probe comprises at least 40, at least 50, at least 75, at least 100, at least 150, or at least 200 consecutive nucleotides from the polynucleotide of the invention.

Oligonucleotides, generally 20-mers, are prepared from a large number, e.g. 50, 100, or 200, of polynucleotides of the invention using commercially available oligonucleotide services such as Genset, Paris, France. Cell samples from the test subject are processed for DNA using techniques well known to those with skill in the art. The nucleic acid is digested with restriction enzymes such as EcoRI and XbaI. Following digestion, samples are applied to wells for electrophoresis. The procedure, as known in the art, may be modified to accommodate polyacrylamide electrophoresis, however in this example, samples containing 5 ug of DNA are loaded into wells and separated on 0.8% agarose gels. The gels are transferred onto nitrocellulose using standard Southern blotting techniques.

10 ng of each of the oligonucleotides are pooled and end-labeled with $P^{32}$. The nitrocellulose is prehybridized with blocking solution and hybridized with the labeled probes. Following hybridization and washing, the nitrocellulose filter is exposed to X-Omat AR X-ray film. The resulting hybridization pattern will be unique for each individual.

It is additionally contemplated within this example that the number of probe sequences used can be varied for additional accuracy or clarity.

To Find Corresponding Genomic DNA Sequences

The GENSET cDNAs of the invention may also be used to clone sequences located upstream of the cDNAs of the invention on the corresponding genomic DNA. Such upstream sequences may be capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion.

Use of cDNAs or Fragments thereof to Clone Upstream Sequences from Genomic DNA

Sequences derived from polynucleotides of the inventions may be used to isolate the promoters of the corresponding genes using chromosome walking techniques. In one chromosome walking technique, which utilizes the GenomeWalker™ kit available from Clontech, five complete genomic DNA samples are each digested with a different restriction enzyme which has a 6 base recognition site and leaves a blunt end. Following digestion, oligonucleotide adapters are ligated to each end of the resulting genomic DNA fragments.

For each of the five genomic DNA libraries, a first PCR reaction is performed according to the manufacturer's instructions (which are incorporated herein by reference) using an outer adaptor primer provided in the kit and an outer gene specific primer. The gene specific primer should be selected to be specific for the polynucleotide of the invention of interest and should have a melting temperature, length, and location in the polynucleotide of the invention which is consistent with its use in PCR reactions. Each first PCR reaction contains 5 ng of genomic DNA, 5 µl of 10×Tth reaction buffer, 0.2 mM of each dNTP, 0.2 µM each of outer adaptor primer and outer gene specific primer, 1.1 mM of $Mg(OAc)_2$, and 1 µl of the Tth polymerase 5× mix in a total volume of 50 µl. The reaction cycle for the first PCR reaction is as follows: 1 min at 94 degree Celsius/2 sec at 94 degree Celsius, 3 min at 72 degree Celsius (7 cycles)/2 sec at 94 degree Celsius, 3 min at 67 degree Celsius (32 cycles)/5 min at 67 degree Celsius.

The product of the first PCR reaction is diluted and used as a template for a second PCR reaction according to the manufacturer's instructions using a pair of nested primers which are located internally on the amplicon resulting from the first PCR reaction. For example, 5 µl of the reaction product of the first PCR reaction mixture may be diluted 180 times. Reactions are made in a 50 µl volume having a composition identical to that of the first PCR reaction except the nested primers are used. The first nested primer is specific for the adaptor, and is provided with the GenomeWalker™ kit. The second nested primer is specific for the particular polynucleotide of the invention for which the promoter is to be cloned and should have a melting temperature, length, and location in the polynucleotide of the invention which is consistent with its use in PCR reactions. The reaction parameters of the second PCR reaction are as follows: 1 min at 94 degree Celsius/2 sec at 94 degree Celsius, 3 min at 72 degree Celsius (6 cycles)/2 sec at 94 degree Celsius, 3 min at 67 degree Celsius (25 cycles)/5 min at 67 degree Celsius The product of the second PCR reaction is purified, cloned, and sequenced using standard techniques. Alternatively, two or more human genomic DNA libraries can be constructed by using two or more restriction enzymes. The digested genomic DNA is cloned into vectors which can be converted into single stranded, circular, or linear DNA. A biotinylated oligonucleotide comprising at least 15 nucleotides from the polynucleotide of the invention sequence is hybridized to the single stranded DNA. Hybrids between the biotinylated oligonucleotide and the single stranded DNA containing the polynucleotide of the invention sequence are isolated as described herein. Thereafter, the single stranded DNA containing the polynucleotide of the invention sequence is released from the beads and converted into double stranded DNA using a primer specific for the polynucleotide of the invention sequence or a primer corresponding to a sequence included in the cloning vector. The resulting double stranded DNA is transformed into bacteria. DNAs containing the GENSET polynucleotide sequences are identified by colony PCR or colony hybridization.

Identification of Promoters in Cloned Upstream Sequences

Once the upstream genomic sequences have been cloned and sequenced as described above, prospective promoters and transcription start sites within the upstream sequences may be identified by comparing the sequences upstream of the polynucleotides of the inventions with databases containing known transcription start sites, transcription factor binding sites, or promoter sequences.

In addition, promoters in the upstream sequences may be identified using promoter reporter vectors as follows. The expression of the reporter gene will be detected when placed under the control of regulatory active polynucleotide fragments or variants of the GENSET promoter region located upstream of the first exon of the GENSET gene. Suitable promoter reporter vectors, into which the GENSET promoter sequences may be cloned include pSEAP-Basic, pSEAP-Enhancer, pβgal-Basic, pβgal-Enhancer, or pEGFP-1 Promoter Reporter vectors available from Clontech, or pGL2-basic or pGL3-basic promoterless luciferase reporter gene vector from Promega. Briefly, each of these promoter reporter vectors include multiple cloning sites positioned upstream of a reporter gene encoding a readily assayable protein such as secreted alkaline phosphatase, luciferase, beta-galactosidase, or green fluorescent protein. The sequences upstream the GENSET coding region are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for increasing transcription levels from weak promoter sequences. A significant level of expression above that observed with the vector lacking an insert indicates that a promoter sequence is present in the inserted upstream sequence.

Promoter sequence within the upstream genomic DNA may be further defined by site directed mutagenesis, linker scanning analysis, or other techniques familiar to those skilled in the art. For example, the boundaries of promoters may be further investigated by constructing nested 5' and/or 3' deletions in the upstream DNA using conventional techniques such as Exonuclease III or appropriate restriction endonuclease digestion. The resulting deletion fragments can be inserted into the promoter reporter vector to determine whether the deletion has increased, reduced or illuminated promoter activity, such as described, for example, by Coles et al. (1998), the disclosure of which is incorporated herein by reference in its entirety. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into cloning sites in promoter reporter vectors. This type of assay is well known to those skilled in the art and is described in WO 97/17359, U.S. Pat. No. 5,374,544; EP 582 796; U.S. Pat. Nos. 5,698,389; 5,643,746; 5,502,176; and 5,266,488; the disclosures of which are incorporated by reference herein in their entirety.

The strength and the specificity of the promoter of each GENSET gene can be assessed through the expression levels of a detectable polynucleotide operably linked to the GENSET promoter in different types of cells and tissues. The detectable polynucleotide may be either a polynucleotide that specifically hybridizes with a predefined oligonucleotide probe, or a polynucleotide encoding a detectable protein, including a GENSET polypeptide or a fragment or a variant thereof. This type of assay is well known to those skilled in the art and is described in U.S. Pat. Nos. 5,502,176; and 5,266,488; the disclosures of which are incorporated by reference herein in their entirety. Some of the methods are discussed in more detail elsewhere in the application.

The promoters and other regulatory sequences located upstream of the polynucleotides of the inventions may be used to design expression vectors capable of directing the expression of an inserted gene in a desired spatial, temporal, developmental, or quantitative manner. A promoter capable of directing the desired spatial, temporal, developmental, and quantitative patterns may be selected using the results of the expression analysis described herein. For example, if a promoter which confers a high level of expression in muscle is desired, the promoter sequence upstream of a polynucleotide of the invention derived from an mRNA which is expressed at a high level in muscle may be used in the expression vector. Such vectors are described in more detail elsewhere in the application.

Preferably, the desired promoter is placed near multiple restriction sites to facilitate the cloning of the desired insert downstream of the promoter, such that the promoter is able to drive expression of the inserted gene. The promoter may be inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted into the expression vector.

To Find Similar Sequences

Polynucleotides of the invention may be used to isolate and/or purify nucleic acids similar thereto using any methods well known to those skilled in the art including the techniques based on hybridization or on amplification described in this section. These methods may be used to obtain the genomic DNAs which encode the mRNAs from which the GENSET cDNAs are derived, mRNAs corresponding to GENSET cDNAs, or nucleic acids which are homologous to GENSET cDNAs or fragments thereof, such as variants, species homologues or orthologs. Thus, a plurality of cDNAs similar to GENSET polynucleotides may be provided as cDNA libraries for subsequent evaluation of the encoded proteins or use in diagnostic assays as described herein. cDNAs prepared by any method described therein may be subsequently engineered to obtain nucleic acids which include desired fragments of the cDNA using conventional techniques such as subcloning, PCR, or in vitro oligonucleotide synthesis. For example, nucleic acids which include only the coding sequences may be obtained using techniques known to those skilled in the art. Similarly, nucleic acids containing any other desired fragment of the coding sequences for the encoded protein may be obtained.

Indeed, cDNAs of the present invention or fragments thereof may be used to isolate nucleic acids similar to cDNAs from a cDNA library or a genomic DNA library. Such cDNA libraries or genomic DNA libraries may be obtained from a commercial source or made using techniques familiar to those skilled in the art such as those described in PCT publication WO 00/37491, which disclosure is hereby incorporated by reference in its entirety. Examples of methods for obtaining nucleic acids similar to GENSET polynucleotides are described below.

Hybridization-based Methods

Techniques for identifying cDNA clones in a cDNA library which hybridize to a given probe sequence are disclosed in Sambrook et al., (1989) and in Hames and Higgins (1985), the disclosures of which are incorporated herein by reference in their entireties. The same techniques may be used to isolate genomic DNAs.

Briefly, cDNA or genomic DNA clones which hybridize to the detectable probe are identified and isolated for further manipulation as follows. Any polynucleotide fragment of the invention may be used as a probe, in particular those defined in the "Oligonucleotide primers and probes" section. A probe comprising at least 10 consecutive nucleotides from a GENSET cDNA or fragment thereof is labeled with a detectable label such as a radioisotope or a fluorescent molecule. Preferably, the probe comprises at least 12, 15, or 17 consecutive nucleotides from the cDNA or fragment thereof. More preferably, the probe comprises 20 to 30 consecutive nucleotides from the cDNA or fragment thereof. In some embodiments, the probe comprises more than 30 nucleotides from the cDNA or fragment thereof.

Techniques for labeling the probe are well known and include phosphorylation with polynucleotide kinase, nick translation, in vitro transcription, and non radioactive techniques. The cDNAs or genomic DNAs in the library are transferred to a nitrocellulose or nylon filter and denatured. After blocking of non specific sites, the filter is incubated with the labeled probe for an amount of time sufficient to allow binding of the probe to cDNAs or genomic DNAs containing a sequence capable of hybridizing thereto.

By varying the stringency of the hybridization conditions used to identify cDNAs or genomic DNAs which hybridize to the detectable probe, cDNAs or genomic DNAs having different levels of identity to the probe can be identified and isolated as described below.

Stringent Conditions

"Stringent hybridization conditions" are defined as conditions in which only nucleic acids having a high level of identity to the probe are able to hybridize to said probe. These conditions may be calculated as follows:

For probes between 14 and 70 nucleotides in length the melting temperature (Tm) is calculated using the formula: Tm=81.5+16.6(log (Na+)+0.41(fraction G+C)−(600/N) where N is the length of the probe.

If the hybridization is carried out in a solution containing formamide, the melting temperature may be calculated using the equation: Tm=81.5+16.6(log (Na+))+0.41(fraction G+C)−(0.63% formamide)−(600/N) where N is the length of the probe.

Prehybridization may be carried out in 6×SSC, 5× Denhardt's reagent, 0.5% SDS, 100 μg denatured fragmented salmon sperm DNA or 6×SSC, 5× Denhardt's reagent, 0.5% SDS, 100 μg denatured fragmented salmon sperm DNA, 50% formamide. The formulas for SSC and Denhardt's solutions are listed in Sambrook et al., 1986.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to nucleic acids containing sequences complementary thereto or homologous thereto. For probes over 200 nucleotides in length, the hybridization may be carried out at 15–25° C. below the Tm. For shorter probes, such as oligonucleotide probes, the hybridization may be conducted at 15–25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

Nucleic acids which have hybridized to the probe are identified by autoradiography or other conventional techniques.

Low and Moderate Conditions

Changes in the stringency of hybridization and signal detection are primarily accomplished through the manipulation of formamide concentration (lower percentages of formamide result in lowered stringency); salt conditions, or temperature. The above procedure may thus be modified to identify nucleic acids having decreasing levels of identity to the probe sequence. For example, the hybridization temperature may be decreased in increments of 5° C. from 68° C. to 42° C. in a hybridization buffer having a sodium concentration of approximately 1M. Following hybridization, the filter may be washed with 2×SSC, 0.5% SDS at the temperature of hybridization. These conditions are considered to be "moderate" conditions above 50° C. and "low" conditions below 50° C. Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of identity to the probe. Following hybridization, the filter may be washed with 6×SSC, 0.5% SDS at 50° C. These conditions are considered to be "moderate" conditions above 25% formamide and "low" conditions below 25% formamide. cDNAs or genomic DNAs which have hybridized to the probe are identified by autoradiography or other conventional techniques.

Note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

Consequently, the present invention encompasses methods of isolating nucleic acids similar to the polynucleotides of the invention, comprising the steps of:

a) contacting a collection of cDNA or genomic DNA molecules with a detectable probe comprising at least 12, 15, 18, 20, 23, 25, 28, 30, 35, 40 or 50 consecutive nucleotides of a sequence selected from the group consisting of the sequences of SEQ ID Nos: 1–241, the sequences of clones inserts of the deposited clone pool and sequences complementary thereto under stringent, moderate or low conditions which permit said probe to hybridize to at least a cDNA or genomic DNA molecule in said collection;

b) identifying said cDNA or genomic DNA molecule which hybridizes to said detectable probe; and c) isolating said cDNA or genomic DNA molecule which hybridized to said probe.

PCR-based Methods

In addition to the above described methods, other protocols are available to obtain homologous cDNAs using GENSET cDNA of the present invention or fragment thereof as outlined in the following paragraphs.

cDNAs may be prepared by obtaining mRNA from the tissue, cell, or organism of interest using mRNA preparation procedures utilizing polyA selection procedures or other techniques known to those skilled in the art. A first primer capable of hybridizing to the polyA tail of the mRNA is hybridized to the mRNA and a reverse transcription reaction is performed to generate a first cDNA strand.

The term "capable of hybridizing to the polyA tail of said mRNA" refers to and embraces all primers containing stretches of thymidine residues, so-called oligo(dT) primers, that hybridize to the 3' end of eukaryotic poly(A)+ mRNAs to prime the synthesis of a first cDNA strand. Techniques for generating said oligo (dT) primers and hybridizing them to mRNA to subsequently prime the reverse transcription of said hybridized mRNA to generate a first cDNA strand are well known to those skilled in the art and are described in Current Protocols in Molecular Biology, John Wiley and Sons, Inc. 1997 and Sambrook et al., 1989. Preferably, said oligo (dT) primers are present in a large excess in order to allow the hybridization of all mRNA 3' ends to at least one oligo (dT) molecule. The priming and reverse transcription steps are preferably performed between 37° C. and 55° C. depending on the type of reverse transcriptase used. Preferred oligo(dT) primers for priming reverse transcription of mRNAs are oligonucleotides containing a stretch of thymidine residues of sufficient length to hybridize specifically to the polyA tail of mRNAs, preferably of 12 to 18 thymidine residues in length. More preferably, such oligo(T) primers comprise an additional sequence upstream of the poly(dT) stretch in order to allow the addition of a given sequence to the 5' end of all first cDNA strands which may then be used to facilitate subsequent manipulation of the cDNA. Preferably, this added sequence is 8 to 60 residues in length. For instance, the addition of a restriction site in 5' of cDNAs facilitates subcloning of the obtained cDNA. Alternatively, such an added 5' end may also be used to design primers of PCR to specifically amplify cDNA clones of interest.

The first cDNA strand is then hybridized to a second primer. Any polynucleotide fragment of the invention may be used, and in particular those described in the "Oligonucleotide primers and probes" section. This second primer contains at least 10 consecutive nucleotides of a polynucleotide of the invention. Preferably, the primer comprises at least 10, 12, 15, 17, 18, 20, 23, 25, or 28 consecutive nucleotides of a polynucleotide of the invention. In some embodiments, the primer comprises more than 30 nucleotides of a polynucleotide of the invention. If it is desired to obtain cDNAs containing the full protein coding sequence, including the authentic translation initiation site, the second primer used contains sequences located upstream of the translation initiation site. The second primer is extended to generate a second cDNA strand complementary to the first cDNA strand. Alternatively, RT-PCR may be performed as described above using primers from both ends of the cDNA to be obtained.

The double stranded cDNAs made using the methods described above are isolated and cloned. The cDNAs may be cloned into vectors such as plasmids or viral vectors capable of replicating in an appropriate host cell. For example, the host cell may be a bacterial, mammalian, avian, or insect cell.

Techniques for isolating mRNA, reverse transcribing a primer hybridized to mRNA to generate a first cDNA strand, extending a primer to make a second cDNA strand complementary to the first cDNA strand, isolating the double stranded cDNA and cloning the double stranded cDNA are well known to those skilled in the art and are described in *Current Protocols in Molecular Biology*, John Wiley & Sons, Inc. 1997 and Sambrook et al., 1989.

Consequently, the present invention encompasses methods of making cDNAs. In a first embodiment, the method of making a cDNA comprises the steps of a) contacting a collection of mRNA molecules from human cells with a primer comprising at least 12, 15, 18, 20, 23, 25, 28, 30, 35, 40, or 50 consecutive nucleotides of a sequence selected from the group consisting of the sequences complementary to SEQ ID Nos: 1–241 and sequences complementary to a clone insert of the deposited clone pool;

b) hybridizing said primer to an mRNA in said collection;

c) reverse transcribing said hybridized primer to make a first cDNA strand from said mRNA;

d) making a second cDNA strand complementary to said first cDNA strand; and e) isolating the resulting cDNA comprising said first cDNA strand and said second cDNA strand.

Another embodiment of the present invention is a purified cDNA obtainable by the method of the preceding paragraph. In one aspect of this embodiment, the cDNA encodes at least a portion of a human polypeptide.

In a second embodiment, the method of making a cDNA comprises the steps of a) contacting a collection of mRNA molecules from human cells with a first primer capable of hybridizing to the polyA tail of said mRNA;

b) hybridizing said first primer to said polyA tail;

c) reverse transcribing said mRNA to make a first cDNA strand;

d) making a second cDNA strand complementary to said first cDNA strand using at least one primer comprising at least 12, 15, 18, 20, 23, 25, 28, 30, 35, 40, or 50 consecutive nucleotides of a sequence selected from the group consisting of SEQ ID Nos: 1–241 and sequences of clone inserts of the deposited clone pool; and e) isolating the resulting cDNA comprising said first cDNA strand and said second cDNA strand.

In another aspect of this method the second cDNA strand is made by a) contacting said first cDNA strand with a second primer comprising at least 12, 15, 18, 20, 23, 25, 28, 30, 35, 40, or 50 consecutive nucleotides of a sequence selected from the group consisting of SEQ ID Nos: 1–241 and sequences of clone inserts of the deposited clone pool, and a third primer which sequence is fully included within the sequence of said first primer;

b) performing a first polymerase chain reaction with said second and third primers to generate a first PCR product;

c) contacting said first PCR product with a fourth primer, comprising at least 12, 15, 18, 20, 23, 25, 28, 30, 35, 40, or 50 consecutive nucleotides of said sequence selected from the group consisting of SEQ ID Nos: 1–241 and sequences of clone inserts of the deposited clone pool, and a fifth primer, which sequence is fully included within the sequence of said third primer, wherein said fourth and fifth hybridize to sequences within said first PCR product; and d) performing a second polymerase chain reaction, thereby generating a second PCR product.

Alternatively, the second cDNA strand may be made by contacting said first cDNA strand with a second primer comprising at least 12, 15, 18, 20, 23, 25, 28, 30, 35, 40, or 50 consecutive nucleotides of a sequence selected from the group consisting of SEQ ID Nos: 1–241 and sequences of clone inserts of the deposited clone pool, and a third primer which sequence is fully included within the sequence of said first primer and performing a polymerase chain reaction with said second and third primers to generate said second cDNA strand.

Alternatively, the second cDNA strand may be made by a) contacting said first cDNA strand with a second primer comprising at least 12, 15, 18, 20, 23, 25, 28, 30, 35, 40, or 50 consecutive nucleotides of a sequence selected from the group consisting of SEQ ID Nos: 1–241 and sequences of clone inserts of the deposited clone pool;

b) hybridizing said second primer to said first strand cDNA; and c) extending said hybridized second primer to generate said second cDNA strand.

Another embodiment of the present invention is a purified cDNA obtainable by a method of making a cDNA of the invention. In one aspect of this embodiment, said cDNA encodes at least a portion of a human polypeptide.

Other Protocols

Alternatively, other procedures may be used for obtaining homologous cDNAs. In one approach, cDNAs are prepared from mRNA and cloned into double stranded phagemids as follows. The cDNA library in the double stranded phagemids is then rendered single stranded by treatment with an endonuclease, such as the Gene II product of the phage F1 and an exonuclease (Chang et al., 1993, which disclosure is hereby incorporated by reference in its entirety). A biotinylated oligonucleotide comprising the sequence of a fragment of a known GENSET cDNA, genomic DNA or fragment thereof is hybridized to the single stranded phagemids. Preferably, the fragment comprises at least 10, 12, 15, 17, 18, 20, 23, 25, or 28 consecutive nucleotides of a sequence selected from the group consisting of the sequences of SEQ ID Nos: 1–241 and sequences of clone inserts of the deposited clone pool.

Hybrids between the biotinylated oligonucleotide and phagemids are isolated by incubating the hybrids with streptavidin coated paramagnetic beads and retrieving the beads with a magnet (Fry et al, 1992, which disclosure is hereby incorporated by reference in its entirety). Thereafter, the resulting phagemids are released from the beads and converted into double stranded DNA using a primer specific for the GENSET cDNA or fragment used to design the biotinylated oligonucleotide. Alternatively, protocols such as the Gene Trapper kit (Gibco BRL), which disclosure is which disclosure is hereby incorporated by reference in its entirety, may be used. The resulting double stranded DNA is transformed into bacteria. Homologous cDNAs to the GENSET cDNA or fragment thereof sequence are identified by colony PCR or colony hybridization.

As a Chromosome Marker

Chromosomal localization of the cDNA of the present invention were determined using information from public and proprietary databases. Table VIII lists the putative chromosomal location of the polynucleotides of the present invention. Column one lists the sequence identification number with the corresponding chromosomal location listed in column two. Thus, the present invention also relates to methods and compositions using the chromosomal location of the polynucleotides of the invention to construct a human high resolution map or to identify a given chromosome in a sample using any techniques known to those skilled in the art including those disclosed below.

GENSET polynucleotides may also be mapped to their chromosomal locations using any methods or techniques known to those skilled in the art including radiation hybrid (RH) mapping, PCR-based mapping and Fluorescence in situ hybridization (FISH) mapping described below.

Radiation Hybrid Mapping

Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different fragments of the human genome. This technique is described by Benham et al. (1989) and Cox et al, (1990), which disclosures are hereby incorporated by reference in their entireties. The random and independent nature of the subclones permits efficient mapping of any human genome marker. Human DNA isolated from a panel of 80–100 cell lines provides a mapping reagent for ordering GENSET cDNAs or genomic DNAs. In this approach, the frequency of breakage between markers is used to measure distance, allowing construction of fine resolution maps as has been done using conventional ESTs (Schuler et al., 1996), which disclosure is hereby incorporated by reference in its entirety.

RH mapping has been used to generate a high-resolution whole genome radiation hybrid map of human chromosome 17q22–q25.3 across the genes for growth hormone (GM) and thymidine kinase (TK) (Foster et al., 1996), the region surrounding the Gorlin syndrome gene (Obermayr et al., 1996), 60 loci covering the entire short arm of chromosome 12 (Raeymaekers et al., 1995), the region of human chromosome 22 containing the neurofibromatosis type 2 locus (Frazer et al., 1992) and 13 loci on the long arm of chromosome 5 (Warrington et al., 1991), which disclosures are hereby incorporated by reference in their entireties.

Mapping of cDNAs to Human Chromosomes Using PCR Techniques

GENSET cDNAs and genomic DNAs may be assigned to human chromosomes using PCR based methodologies. In such approaches, oligonucleotide primer pairs are designed from the cDNA sequence to minimize the chance of amplifying through an intron. Preferably, the oligonucleotide primers are 18–23 bp in length and are designed for PCR amplification. The creation of PCR primers from known sequences is well known to those with skill in the art. For a review of PCR technology see Erlich (1992), which disclosure is hereby incorporated by reference in its entirety.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 uCu of a $^{32}$P-labeled deoxycytidine triphosphate. The PCR is performed in a microplate thermocycler (Techne) under the following conditions: 30 cycles of 94 degree Celsius, 1.4 min; 55 degree Celsius, 2 min; and 72 degree Celsius, 2 min; with a final extension at 72 degree Celsius for 10 min. The amplified products are analyzed on a 6% polyacrylamide sequencing gel and visualized by autoradiography. If the length of the resulting PCR product is identical to the distance between the ends of the primer sequences in the cDNA from which the primers are derived, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given cDNA or genomic DNA. DNA is isolated from the somatic hybrids and used as starting templates for PCR reactions using the primer pairs from the GENSET cDNAs or genomic DNAs. Only those somatic cell hybrids with chromosomes containing the human gene corresponding to the GENSET cDNA or genomic DNA will yield an amplified fragment. The GENSET cDNAs or genomic DNAs are assigned to a chromosome by analysis of the segregation pattern of PCR products from the somatic hybrid DNA templates. The single human chromosome present in all cell hybrids that give rise to an amplified fragment is the chromosome containing that GENSET cDNA or genomic DNA. For a review of techniques and analysis of results from somatic cell gene mapping experiments, see Ledbetter et al., (1990), which disclosure is hereby incorporated by reference in its entirety.

Mapping of cDNAs to Chromosomes Using Fluorescence in situ Hybridization

Fluorescence in situ hybridization allows the GENSET cDNA or genomic DNA to be mapped to a particular location on a given chromosome. The chromosomes to be used for fluorescence in situ hybridization techniques may be obtained from a variety of sources including cell cultures, tissues, or whole blood.

In a preferred embodiment, chromosomal localization of a GENSET cDNA or genomic DNA is obtained by FISH as described by Cherif et al. (1990), which disclosure is hereby incorporated by reference in its entirety. Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 uM) is added for 17 h, followed by addition of 5-bromodeoxyuridine (5-BudR, 0.1 mM) for 6 h. Colcemid (1 ug/ml) is added for the last 15 min before harvesting the cells. Cells are collected, washed in RPMI, incubated with a hypotonic solution of KCl (75 mM) at 37 degree Celsius for 15 min and fixed in three changes of methanol:acetic acid (3:1). The cell suspension is dropped onto a glass slide and air dried. The GENSET cDNA or genomic DNA is labeled with biotin-16 dUTP by nick translation according to the manufacturer's instructions (Bethesda Research Laboratories, Bethesda, Md.), purified using a Sephadex G-50 column (Pharmacia, Upssala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70 degree Celsius for 5–10 mm.

Slides kept at −20 degree Celsius are treated for 1 h at 37 degree Celsius with RNase A (100 ug/ml), rinsed three times in 2×SSC and dehydrated in an ethanol series. Chromosome preparations are denatured in 70% formamide, 2×SSC for 2 min at 70 degree Celsius, then dehydrated at 4 degree Celsius. The slides are treated with proteinase K (10 ug/100 ml in 20 mM Tris-HCl, 2 mM $CaCl_2$) at 37 degree Celsius for 8 min and dehydrated. The hybridization mixture containing the probe is placed on the slide, covered with a coverslip, sealed with rubber cement and incubated overnight in a humid chamber at 37 degree Celsius. After hybridization and post-hybridization washes, the biotinylated probe is detected by avidin-FITC and amplified with additional layers of biotinylated goat anti-avidin and avidin-FITC. For chromosomal localization, fluorescent R-bands are obtained as previously described (Cherif et al., 1990). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular GENSET cDNA or genomic DNA may be localized to a particular cytogenetic R-band on a given chromosome.

Use of cDNAs to Construct or Expand Chromosome Maps

Once the GENSET cDNAs or genomic DNAs have been assigned to particular chromosomes using any technique known to those skilled in the art those skilled in the art, particularly those described herein, they may be utilized to construct a high resolution map of the chromosomes on which they are located or to identify the chromosomes in a sample.

Chromosome mapping involves assigning a given unique sequence to a particular chromosome as described above. Once the unique sequence has been mapped to a given chromosome, it is ordered relative to other unique sequences located on the same chromosome. One approach to chromosome mapping utilizes a series of yeast artificial chromosomes (YACs) bearing several thousand long inserts derived from the chromosomes of the organism from which the GENSET cDNAs or genomic DNAs are obtained. This approach is described in Nagaraja et al. (1997), which disclosure is hereby incorporated by reference in its entirety. Briefly, in this approach each chromosome is broken into overlapping pieces which are inserted into the YAC vector. The YAC inserts are screened using PCR or other methods to determine whether they include the GENSET cDNA or genomic DNA whose position is to be determined. Once an insert has been found which includes the GENSET cDNA or genomic DNA, the insert can be analyzed by PCR or other methods to determine whether the insert also contains other sequences known to be on the chromosome or in the region from which the GENSET cDNA or genomic DNA was derived. This process can be repeated for each insert in the YAC library to determine the location of each of the GENSET cDNA or genomic DNA relative to one another and to other known chromosomal markers. In this way, a high resolution map of the distribution of numerous unique markers along each of the organisms chromosomes may be obtained.

Identification of Genes Associated with Hereditary Diseases or Drug Response

This example illustrates an approach useful for the association of GENSET cDNAs or genomic DNAs with particular phenotypic characteristics. In this example, a particular GENSET cDNA or genomic DNA is used as a test probe to associate that GENSET cDNA or genomic DNA with a particular phenotypic characteristic.

GENSET cDNAs or genomic DNAs are mapped to a particular location on a human chromosome using techniques such as those described herein or other techniques known in the art. A search of Mendelian Inheritance in Man (V. McKusick, *Mendelian Inheritance in Man* (available on line through Johns Hopkins University Welch Medical Library) reveals the region of the human chromosome which contains the GENSET cDNA or genomic DNA to be a very gene rich region containing several known genes and several diseases or phenotypes for which genes have not been identified. The gene corresponding to this GENSET cDNA or genomic DNA thus becomes an immediate candidate for each of these genetic diseases.

Cells from patients with these diseases or phenotypes are isolated and expanded in culture. PCR primers from the GENSET cDNA or genomic DNA are used to screen genomic DNA, mRNA or cDNA obtained from the patients. GENSET cDNAs or genomic DNAs that are not amplified in the patients can be positively associated with a particular disease by further analysis. Alternatively, the PCR analysis may yield fragments of different lengths when the samples are derived from an individual having the phenotype associated with the disease than when the sample is derived from a healthy individual, indicating that the gene containing the cDNA may be responsible for the genetic disease.

Uses of Polynucleotides in Recombinant Vectors

The present invention also relates to recombinant vectors, which include the isolated polynucleotides of the present invention, or fragments thereof and to host cells recombinant for a polynucleotide of the invention, such as the above vectors, as well as to methods of making such vectors and host cells and for using them for production of GENSET polypeptides by recombinant techniques.

Recombinant Vectors

The term "vector" is used herein to designate either a circular or a linear DNA or RNA molecule, which is either double-stranded or single-stranded, and which comprise at least one polynucleotide of interest that is sought to be transferred in a cell host or in a unicellular or multicellular host organism. The present invention encompasses a family of recombinant vectors that comprise a regulatory polynucleotide and/or a coding polynucleotide derived from either the GENSET genomic sequence or the cDNA sequence. Generally, a recombinant vector of the invention may comprise any of the polynucleotides described herein, including regulatory sequences, coding sequences and polynucleotide constructs, as well as any GENSET primer or probe as defined herein.

In a first preferred embodiment, a recombinant vector of the invention is used to amplify the inserted polynucleotide derived from a GENSET genomic sequence or a GENSET cDNA, for example any cDNA selected from the group consisting of sequences of SEQ ID Nos: 1–241, sequences of clone inserts of the deposited clone pool, variants and fragments thereof in a suitable cell host, this polynucleotide being amplified at every time that the recombinant vector replicates.

A second preferred embodiment of the recombinant vectors according to the invention comprises expression vectors comprising either a regulatory polynucleotide or a coding nucleic acid of the invention, or both. Within certain embodiments, expression vectors are employed to express a GENSET polypeptide which can be then purified and, for example be used in ligand screening assays or as an immunogen in order to raise specific antibodies directed against the GENSET protein. In other embodiments, the expression vectors are used for constructing transgenic animals and also for gene therapy. Expression requires that appropriate signals are provided in the vectors, said signals including various regulatory elements, such as enhancers/promoters from both viral and mammalian sources that drive expression of the genes of interest in host cells. Dominant drug selection markers for establishing permanent, stable cell clones expressing the products are generally included in the expression vectors of the invention, as they are elements that link expression of the drug selection markers to expression of the polypeptide.

More particularly, the present invention relates to expression vectors which include nucleic acids encoding a GENSET protein, preferably a GENSET protein with an amino acid sequence selected from the group consisting of sequences of SEQ ID Nos: 242–482, mature polypeptides included in sequences of SEQ ID Nos: 242–272 and 274–384, and sequences of full-length or mature polypeptides encoded by the clone inserts of the deposited clone pool, as well as variants and fragments thereof. The polynucleotides of the present invention may be used to express an encoded protein in a host organism to produce a beneficial effect. In such procedures, the encoded protein may be transiently expressed in the host organism or stably expressed in the host organism. The encoded protein may have any of the activities described herein. The encoded protein may be a protein which the host organism lacks or, alternatively, the encoded protein may augment the existing levels of the protein in the host organism.

Some of the elements which can be found in the vectors of the present invention are described in further detail in the following sections.

General Features of the Expression Vectors of the Invention

A recombinant vector according to the invention comprises, but is not limited to, a YAC (Yeast Artificial Chromosome), a BAC (Bacterial Artificial Chromosome), a phage, a phagemid, a cosmid, a plasmid or even a linear DNA molecule which may comprise a chromosomal, non-chromosomal, semi-synthetic and synthetic DNA. Such a recombinant vector can comprise a transcriptional unit comprising an assembly of:

(1) a genetic element or elements having a regulatory role in gene expression, for example promoters or enhancers. Enhancers are cis-acting elements of DNA, usually from about 10 to 300 bp in length that act on the promoter to increase the transcription.

(2) a structural or coding sequence which is transcribed into mRNA and eventually translated into a polypeptide, said structural or coding sequence being operably linked to the regulatory elements described in (1); and (3) appropriate transcription initiation and termination sequences. Structural units intended for use in yeast or eukaryotic expression systems preferably include a leader sequence enabling extracellular secretion of translated protein by a host cell. Alternatively, when a recombinant protein is expressed without a leader or transport sequence, it may include a N-terminal residue. This residue may or may not be subsequently cleaved from the expressed recombinant protein to provide a final product.

Generally, recombinant expression vectors will include origins of replication, selectable markers permitting transformation of the host cell, and a promoter derived from a highly expressed gene to direct transcription of a downstream structural sequence. The heterologous structural sequence is assembled in appropriate phase with translation initiation and termination sequences, and preferably a leader sequence capable of directing secretion of the translated protein into the periplasmic space or the extracellular medium. In a specific embodiment wherein the vector is adapted for transfecting and expressing desired sequences in mammalian host cells, preferred vectors will comprise an origin of replication in the desired host, a suitable promoter and enhancer, and also any necessary ribosome binding sites, polyadenylation signal, splice donor and acceptor sites, transcriptional termination sequences, and 5'-flanking non-transcribed sequences. DNA sequences derived from the SV40 viral genome, for example SV40 origin, early promoter, enhancer, splice and polyadenylation signals may be used to provide the required non-transcribed genetic elements.

The in vivo expression of a GENSET polypeptide of the present invention may be useful in order to correct a genetic defect related to the expression of the native gene in a host organism or to the production of a biologically inactive GENSET protein. Consequently, the present invention also comprises recombinant expression vectors mainly designed for the in vivo production of a GENSET polypeptide of the present invention by the introduction of the appropriate genetic material in the organism or the patient to be treated. This genetic material may be introduced in vitro in a cell that has been previously extracted from the organism, the modified cell being subsequently reintroduced in the said organism, directly in vivo into the appropriate tissue.

Regulatory Elements

The suitable promoter regions used in the expression vectors according to the present invention are chosen taking into account the cell host in which the heterologous gene has to be expressed. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell, such as, for example, a human or a viral promoter.

A suitable promoter may be heterologous with respect to the nucleic acid for which it controls the expression or alternatively can be endogenous to the native polynucleotide containing the coding sequence to be expressed. Additionally, the promoter is generally heterologous with respect to the recombinant vector sequences within which the construct promoter/coding sequence has been inserted.

Promoter regions can be selected from any desired gene using, for example, CAT (chloramphenicol transferase) vectors and more preferably pKK232–8 and pCM7 vectors.

Preferred bacterial promoters are the LacI, LacZ, the T3 or T7 bacteriophage RNA polymerase promoters, the gpt, lambda PR, PL and trp promoters (EP 0036776), the polyhedrin promoter, or the p10 protein promoter from baculovirus (Kit Novagen), (Smith et al., 1983; O'Reilly et al., 1992), which disclosures are hereby incorporated by reference in their entireties, the lambda PR promoter or also the trc promoter.

Eukaryotic promoters include CMV immediate early, HSV thymidine kinase, early and late SV40, LTRs from retrovirus, and mouse metallothionein-L. Selection of a convenient vector and promoter is well within the level of ordinary skill in the art. The choice of a promoter is well within the ability of a person skilled in the field of genetic engineering. For example, one may refer to the book of Sambrook et al., (1989) or also to the procedures described by Fuller et al., (1996), which disclosures are hereby incorporated by reference in their entireties.

Other Regulatory Elements

Where a cDNA insert is employed, one will typically desire to include a polyadenylation signal to effect proper polyadenylation of the gene transcript. The nature of the polyadenylation signal is not believed to be crucial to the successful practice of the invention, and any such sequence may be employed such as human growth hormone and SV40 polyadenylation signals. Also contemplated as an element of the expression cassette is a terminator. These elements can serve to enhance message levels and to minimize read through from the cassette into other sequences.

Selectable Markers

Selectable markers confer an identifiable change to the cell permitting easy identification of cells containing the expression construct. The selectable marker genes for selection of transformed host cells are preferably dihydrofolate reductase or neomycin resistance for eukaryotic cell culture, TRP1 for *S. cerevisiae* or tetracycline, rifampicin or ampicillin resistance in *E. Coli*, or levan saccharase for mycobacteria, this latter marker being a negative selection marker.

Preferred Vectors

Bacterial Vectors

As a representative but non-limiting example, useful expression vectors for bacterial use can comprise a selectable marker and a bacterial origin of replication derived from commercially available plasmids comprising genetic elements of pBR322 (ATCC 37017). Such commercial vectors include, for example, pKK223-3 (Pharmacia, Uppsala, Sweden), and pGEM1 (Promega Biotec, Madison, Wis., U.S.A).

Large numbers of other suitable vectors are known to those of skill in the art, and commercially available, such as the following bacterial vectors: pQE70, pQE60, pQE-9 (Qiagen), pbs, pD10, phagescript, psiX174, pbluescript SK, pbsks, pNH8A, pNH16A, pNH18A, pNH46A (Stratagene); ptrc99a, pKK223-3, pKK233-3, pDR540, pRIT5 (Pharmacia); pWLNEO, pSV2CAT, pOG44, pXT1, pSG (Stratagene); pSVK3, pBPV, pMSG, pSVL (Pharmacia); pQE-30 (QIAexpress).

Bacteriophage Vectors

The P1 bacteriophage vector may contain large inserts ranging from about 80 to about 100 kb. The construction of P1 bacteriophage vectors such as p158 or p158/neo8 are notably described by Sternberg (1992, 1994), which disclosure is hereby incorporated by reference in its entirety. Recombinant PI clones comprising GENSET nucleotide sequences may be designed for inserting large polynucleotides of more than 40 kb (See Linton et al., 1993), which disclosure is hereby incorporated by reference in its entirety. To generate P1 DNA for transgenic experiments, a preferred protocol is the protocol described by McCormick et al. (1994), which disclosure is hereby incorporated by reference in its entirety. Briefly, E. coli (preferably strain NS3529) harboring the P1 plasmid are grown overnight in a suitable broth medium containing 25 ∞g/ml of kanamycin. The P1 DNA is prepared from the E. coli by alkaline lysis using the Qiagen Plasmid Maxi kit (Qiagen, Chatsworth, Calif., U.S.A), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising GENSET nucleotide sequences in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar to those originally reported for the isolation of DNA from YACs (See e. g., Schedl et al., 1993a; Peterson et al., 1993), which disclosures are hereby incorporated by reference in their entireties. At this stage, the resulting purified insert DNA can be concentrated, if necessary, on a Millipore Ultrafree-MC Filter Unit (Millipore, Bedford, Mass., U.S.A—30,000 molecular weight limit) and then dialyzed against microinjection buffer (10 mM Tris-HCl, pH 7.4; 250 µM EDTA) containing 100 mM NaCl, 30 µM spermine, 70 µM spermidine on a microdyalisis membrane (type VS, 0.025 µM from Millipore). The intactness of the purified P1 DNA insert is assessed by electrophoresis on 1% agarose (Sea Kem GTG; FMC Bio-products) pulse-field gel and staining with ethidium bromide.

Viral Vectors

In one specific embodiment, the vector is derived from an adenovirus. Preferred adenovirus vectors according to the invention are those described by Feldman and Steg (1996), or Ohno et al., (1994), which disclosures are hereby incorporated by reference in their entireties. Another preferred recombinant adenovirus according to this specific embodiment of the present invention is the human adenovirus type 2 or 5 (Ad 2 or Ad 5) or an adenovirus of animal origin (French patent application No. FR-93.05954), which disclosure is hereby incorporated by reference in its entirety.

Retrovirus vectors and adeno-associated virus vectors are generally understood to be the recombinant gene delivery systems of choice for the transfer of exogenous polynucleotides in vivo, particularly to mammals, including humans. These vectors provide efficient delivery of genes into cells, and the transferred nucleic acids are stably integrated into the chromosomal DNA of the host. Particularly preferred retroviruses for the preparation or construction of retroviral in vitro or in vitro gene delivery vehicles of the present invention include retroviruses selected from the group consisting of Mink-Cell Focus Inducing Virus, Murine Sarcoma Virus, Reticuloendotheliosis virus and Rous Sarcoma virus. Particularly preferred Murine Leukemia Viruses include the 4070A and the 1504A viruses, Abelson (ATCC No VR-999), Friend (ATCC No VR-245), Gross (ATCC No VR-590), Rauscher (ATCC No VR-998) and Moloney Murine Leukemia Virus (ATCC No VR-190; PCT Application No WO 94/24298). Particularly preferred Rous Sarcoma Viruses include Bryan high titer (ATCC Nos VR-334, VR-657, VR-726, VR-659 and VR-728). Other preferred retroviral vectors are those described in Roth et al. (1996), PCT Application No WO 93/25234, PCT Application No WO 94/06920, Roux et al., (1989), Julan et al., (1992), and Neda et al., (1991), which disclosures are hereby incorporated by reference in their entireties.

Yet another viral vector system that is contemplated by the invention comprises the adeno-associated virus (AAV). The adeno-associated virus is a naturally occurring defective virus that requires another virus, such as an adenovirus or a herpes virus, as a helper virus for efficient replication and a productive life cycle (Muzyczka et al., 1992), which disclosure is hereby incorporated by reference in its entirety. It is also one of the few viruses that may integrate its DNA into non-dividing cells, and exhibits a high frequency of stable integration (Flotte et al. 1992; Samulski et al., 1989; McLaughlin et al., 1989), which disclosures are hereby incorporated by reference in their entireties. One advantageous feature of AAV derives from its reduced efficacy for transducing primary cells relative to transformed cells.

BAC Vectors

The bacterial artificial chromosome (BAC) cloning system (Shizuya et al., 1992), which disclosure is hereby incorporated by reference in its entirety, has been developed to stably maintain large fragments of genomic DNA (100–300 kb) in E. coli. A preferred BAC vector comprises a pBeloBAC11 vector that has been described by Kim et al. (1996), which disclosure is hereby incorporated by reference in its entirety. BAC libraries are prepared with this vector using size-selected genomic DNA that has been partially digested using enzymes that permit ligation into either the Bam HI or HindIII sites in the vector. Flanking these cloning sites are T7 and SP6 RNA polymerase transcription initiation sites that can be used to generate end probes by either RNA transcription or PCR methods. After the construction of a BAC library in E. coli, BAC DNA is purified from the host cell as a supercoiled circle. Converting these circular molecules into a linear form precedes both size determination and introduction of the BACs into recipient cells. The cloning site is flanked by two Not I sites, permitting cloned segments to be excised from the vector by Not I digestion. Alternatively, the DNA insert contained in the pBeloBAC11 vector may be linearized by treatment of the BAC vector with the commercially available enzyme lambda terminase that leads to the cleavage at the unique cosN site, but this cleavage method results in a full length BAC clone containing both the insert DNA and the BAC sequences.

Baculovirus:

Another specific suitable host vector system is the pVL1392/1393 baculovirus transfer vector (Pharmingen) that is used to transfect the SF9 cell line (ATCC No. CRL 1711) which is derived from *Spodoptera frugiperda*. Other suitable vectors for the expression of the GENSET polypeptide of the present invention in a baculovirus expression system include those described by Chai et al., (1993), Vlasak et al., (1983), and Lenhard et al., (1996), which disclosures are hereby incorporated by reference in their entireties.

Delivery of the Recombinant Vectors:

To effect expression of the polynucleotides and polynucleotide constructs of the invention, these constructs must be delivered into a cell. This delivery may be accomplished in vitro, as in laboratory procedures for transforming cell lines, or in vivo or ex vivo, as in the treatment of certain diseases states. One mechanism is viral infection where the expression construct is encapsulated in an infectious viral particle.

Several non-viral methods for the transfer of polynucleotides into cultured mammalian cells are also contemplated by the present invention, and include, without being limited to, calcium phosphate precipitation (Graham et al., 1973; Chen et al., 1987); DEAE-dextran (Gopal, 1985); electroporation (Tur-Kaspa et al., 1986; Potter et al., 1984); direct microinjection (Harland et al., 1985); DNA-loaded liposomes (Nicolau et al., 1982; Fraley et al., 1979); and receptor-mediated transfection. (Wu and Wu, 1987, 1988), which disclosures are hereby incorporated by reference in their entireties. Some of these techniques may be successfully adapted for in vivo or ex vivo use.

Once the expression polynucleotide has been delivered into the cell, it may be stably integrated into the genome of the recipient cell. This integration may be in the cognate location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle.

One specific embodiment for a method for delivering a protein or peptide to the interior of a cell of a vertebrate in vivo comprises the step of introducing a preparation comprising a physiologically acceptable carrier and a naked polynucleotide operatively coding for the polypeptide of interest into the interstitial space of a tissue comprising the cell, whereby the naked polynucleotide is taken up into the interior of the cell and has a physiological effect. This is particularly applicable for transfer in vitro but it may be applied to in vivo as well.

Compositions for use in vitro and in vivo comprising a "naked" polynucleotide are described in PCT application No. WO 90/11092 (Vical Inc.) and also in PCT application No. WO 95/11307 (Institut Pasteur, INSERM, Université d'Ottawa) as well as in the articles of Tacson et al. (1996) and of Huygen et al., (1996), which disclosures are hereby incorporated by reference in their entireties.

In still another embodiment of the invention, the transfer of a naked polynucleotide of the invention, including a polynucleotide construct of the invention, into cells may be proceeded with a particle bombardment (biolistic), said particles being DNA-coated microprojectiles accelerated to a high velocity allowing them to pierce cell membranes and enter cells without killing them, such as described by Klein et al., (1987), which disclosure is hereby incorporated by reference in its entirety.

In a further embodiment, the polynucleotide of the invention may be entrapped in a liposome (Ghosh and Bacchawat, 1991; Wong et al., 1980; Nicolau et al., 1987), which disclosures are hereby incorporated by reference in their entireties.

In a specific embodiment, the invention provides a composition for the in vivo production of the GENSET protein or polypeptide described herein. It comprises a naked polynucleotide operatively coding for this polypeptide, in solution in a physiologically acceptable carrier, and suitable for introduction into a tissue to cause cells of the tissue to express the said protein or polypeptide.

The amount of vector to be injected to the desired host organism varies according to the site of injection. As an indicative dose, it will be injected between 0,1 and 100 µg of the vector in an animal body, preferably a mammal body, for example a mouse body.

In another embodiment of the vector according to the invention, it may be introduced in vitro in a host cell, preferably in a host cell previously harvested from the animal to be treated and more preferably a somatic cell such as a muscle cell. In a subsequent step, the cell that has been transformed with the vector coding for the desired GENSET polypeptide or the desired fragment thereof is reintroduced into the animal body in order to deliver the recombinant protein within the body either locally or systemically.

Secretion Vectors

Some of the GENSET cDNAs or genomic DNAs of the invention may also be used to construct secretion vectors capable of directing the secretion of the proteins encoded by genes inserted in the vectors. Such secretion vectors may facilitate the purification or enrichment of the proteins encoded by genes inserted therein by reducing the number of background proteins from which the desired protein must be purified or enriched. Exemplary secretion vectors are described below.

The secretion vectors of the present invention include a promoter capable of directing gene expression in the host cell, tissue, or organism of interest. Such promoters include the Rous Sarcoma Virus promoter, the SV40 promoter, the human cytomegalovirus promoter, and other promoters familiar to those skilled in the art.

A signal sequence from a polynucleotide of the invention, preferably a signal sequences selected from the group of signal sequences of SEQ ID Nos: 1–31 and 33–143 and signal sequences of clone inserts of the deposited clone pool is operably linked to the promoter such that the mRNA transcribed from the promoter will direct the translation of the signal peptide. The host cell, tissue, or organism may be any cell, tissue, or organism which recognizes the signal peptide encoded by the signal sequence in the GENSET cDNA or genomic DNA. Suitable hosts include mammalian cells, tissues or organisms, avian cells, tissues, or organisms, insect cells, tissues or organisms, or yeast.

In addition, the secretion vector contains cloning sites for inserting genes encoding the proteins which are to be secreted. The cloning sites facilitate the cloning of the insert gene in frame with the signal sequence such that a fusion protein in which the signal peptide is fused to the protein encoded by the inserted gene is expressed from the mRNA transcribed from the promoter. The signal peptide directs the extracellular secretion of the fusion protein.

The secretion vector may be DNA or RNA and may integrate into the chromosome of the host, be stably maintained as an extrachromosomal replicon in the host, be an artificial chromosome, or be transiently present in the host. Preferably, the secretion vector is maintained in multiple copies in each host cell. As used herein, multiple copies means at least 2, 5, 10, 20, 25, 50 or more than 50 copies per cell. In some embodiments, the multiple copies are maintained extrachromosomally. In other embodiments, the multiple copies result from amplification of a chromosomal sequence.

Many nucleic acid backbones suitable for use as secretion vectors are known to those skilled in the art, including retroviral vectors, SV40 vectors, Bovine Papilloma Virus vectors, yeast integrating plasmids, yeast episomal plasmids, yeast artificial chromosomes, human artificial chromosomes, P element vectors, baculovirus vectors, or bacterial plasmids capable of being transiently introduced into the host.

The secretion vector may also contain a polyA signal such that the polyA signal is located downstream of the gene inserted into the secretion vector.

After the gene encoding the protein for which secretion is desired is inserted into the secretion vector, the secretion vector is introduced into the host cell, tissue, or organism using calcium phosphate precipitation, DEAE-Dextran, electroporation, liposome-mediated transfection, viral particles or as naked DNA. The protein encoded by the inserted gene is then purified or enriched from the supernatant using conventional techniques such as ammonium sulfate precipitation, immunoprecipitation, immunochromatography, size exclusion chromatography, ion exchange chromatography, and hplc. Alternatively, the secreted protein may be in a sufficiently enriched or pure state in the supernatant or growth media of the host to permit it to be used for its intended purpose without further enrichment.

The signal sequences may also be inserted into vectors designed for gene therapy. In such vectors, the signal sequence is operably linked to a promoter such that mRNA transcribed from the promoter encodes the signal peptide. A cloning site is located downstream of the signal sequence such that a gene encoding a protein whose secretion is desired may readily be inserted into the vector and fused to the signal sequence. The vector is introduced into an appropriate host cell. The protein expressed from the promoter is secreted extracellularly, thereby producing a therapeutic effect.

Cell Hosts

Another object of the invention comprises a host cell that has been transformed or transfected with one of the polynucleotides described herein, and in particular a polynucleotide either comprising a GENSET regulatory polynucleotide or the polynucleotide coding for a GENSET polypeptide. Also included are host cells that are transformed (prokaryotic cells) or that are transfected (eukaryotic cells) with a recombinant vector such as one of those described above. However, the cell hosts of the present invention can comprise any of the polynucleotides of the present invention. In a preferred embodiment, host cells contain a polynucleotide sequence comprising a sequence selected from the group consisting of sequences of SEQ ID Nos: 1–241, sequences of clone inserts of the deposited clone pool, variants and fragments thereof. Preferred host cells used as recipients for the expression vectors of the invention are the following:

a) Prokaryotic Host Cells: *Escherichia coli* strains (I.E.DH5-α strain), *Bacillus subtilis*, *Salmonella typhimurium*, and strains from species like *Pseudomonas*, *Streptomyces* and *Staphylococcus*.

b) Eukaryotic Host Cells: HeLa cells (ATCC No. CCL2; No. CCL2.1; No. CCL2.2), Cv 1 cells (ATCC No. CCL70), COS cells (ATCC No. CRL1650; No. CRL1651), Sf-9 cells (ATCC No. CRL1711), C127 cells (ATCC No. CRL-1804), 3T3 (ATCC No. CRL-6361), CHO (ATCC No. CCL-61), human kidney 293. (ATCC No. 45504; No. CRL-1573) and BHK (ECACC No. 84100501; No. 84111301).

c) Other Mammalian Host Cells.

The present invention also encompasses primary, secondary, and immortalized homologously recombinant host cells of vertebrate origin, preferably mammalian origin and particularly human origin, that have been engineered to: a) insert exogenous (heterologous) polynucleotides into the endogenous chromosomal DNA of a targeted gene, b) delete endogenous chromosomal DNA, and/or c) replace endogenous chromosomal DNA with exogenous polynucleotides. Insertions, deletions, and/or replacements of polynucleotide sequences may be to the coding sequences of the targeted gene and/or to regulatory regions, such as promoter and enhancer sequences, operably associated with the targeted gene.

In addition to encompassing host cells containing the vector constructs discussed herein, the invention also encompasses primary, secondary, and immortalized host cells of vertebrate origin, particularly mammalian origin, that have been engineered to delete or replace endogenous genetic material (e.g., coding sequence), and/or to include genetic material (e.g., heterologous polynucleotide sequences) that is operably associated with the polynucleotides of the invention, and which activates, alters, and/or amplifies endogenous polynucleotides. For example, techniques known in the art may be used to operably associate heterologous control regions (e.g., promoter and/or enhancer) and endogenous polynucleotide sequences via homologous recombination, see, e.g., U.S. Pat. No. 5,641, 670, issued Jun. 24, 1997; International Publication No. WO 96/29411, published Sep. 26, 1996; International Publication No. WO 94/12650, published Aug. 4, 1994; Koller et al., (1989); and Zijlstra et al. (1989) (The disclosures of each of which are incorporated by reference in their entireties).

The present invention further relates to a method of making a homologously recombinant host cell in vitro or in vivo, wherein the expression of a targeted gene not normally expressed in the cell is altered. Preferably the alteration causes expression of the targeted gene under normal growth conditions or under conditions suitable for producing the polypeptide encoded by the targeted gene. The method comprises the steps of: (a) transfecting the cell in vitro or in vivo with a polynucleotide construct, said polynucleotide construct comprising; (i) a targeting sequence; (ii) a regulatory sequence and/or a coding sequence; and (iii) an unpaired splice donor site, if necessary, thereby producing a transfected cell; and (b) maintaining the transfected cell in vitro or in vivo under conditions appropriate for homologous recombination.

The present invention further relates to a method of altering the expression of a targeted gene in a cell in vitro or in vivo wherein the gene is not normally expressed in the cell, comprising the steps of: (a) transfecting the cell in vitro or in vivo with a polynucleotide construct, said polynucleotide construct comprising: (i) a targeting sequence; (ii) a regulatory sequence and/or a coding sequence; and (iii) an unpaired splice donor site, if necessary, thereby producing a transfected cell; and (b) maintaining the transfected cell in vitro or in vivo under conditions appropriate for homologous recombination, thereby producing a homologously recombinant cell; and (c) maintaining the homologously recombinant cell in vitro or in vivo under conditions appropriate for expression of the gene.

The present invention further relates to a method of making a polypeptide of the present invention by altering the expression of a targeted endogenous gene in a cell in vitro or in vivo wherein the gene is not normally expressed in the cell, comprising the steps of: a) transfecting the cell in vitro with a polynucleotide construct, said polynucleotide construct comprising: (i) a targeting sequence; (ii) a regulatory sequence and/or a coding sequence; and (iii) an unpaired splice donor site, if necessary, thereby producing a transfected cell; (b) maintaining the transfected cell in vitro or in vivo under conditions appropriate for homologous recombination, thereby producing a homologously recombinant cell; and c) maintaining the homologously recombinant cell in vitro or in vivo under conditions appropriate for expression of the gene thereby making the polypeptide.

The present invention further relates to a polynucleotide construct which alters the expression of a targeted gene in a cell type in which the gene is not normally expressed. This occurs when the polynucleotide construct is inserted into the chromosomal DNA of the target cell, wherein said polynucleotide construct comprises: a) a targeting sequence; b) a regulatory sequence and/or coding sequence; and c) an unpaired splice-donor site, if necessary. Further included are a polynucleotide construct, as described above, wherein said polynucleotide construct further comprises a polynucleotide which encodes a polypeptide and is in-frame with the targeted endogenous gene after homologous recombination with chromosomal DNA.

The compositions may be produced, and methods performed, by techniques known in the art, such as those described in U.S. Pat. Nos. 6,054,288; 6,048,729; 6,048,724; 6,048,524; 5,994,127; 5,968,502; 5,965,125; 5,869,239; 5,817,789; 5,783,385; 5,733,761; 5,641,670; 5,580,734; International Publication Nos: WO96/29411, WO 94/12650; and scientific articles described by Koller et al., (1994). (The disclosures of each of which are incorporated by reference in their entireties).

The GENSET gene expression in mammalian cells, preferably human cells, may be rendered defective, or alternatively may be altered by replacing the endogenous GENSET gene in the genome of an animal cell by a GENSET polynucleotide according to the invention. These genetic alterations may be generated by homologous recombination using previously described specific polynucleotide constructs.

Mammal zygotes, such as murine zygotes may be used as cell hosts. For example, murine zygotes may undergo microinjection with a purified DNA molecule of interest, for example a purified DNA molecule that has previously been adjusted to a concentration ranging from 1 ng/ml—for BAC inserts—to 3 ng/µl—for P1 bacteriophage inserts—in 10 mM Tris-HCl, pH 7.4, 250 µM EDTA containing 100 mM NaCl, 30 µM spermine, and 70 µM spermidine. When the DNA to be microinjected has a large size, polyamines and high salt concentrations can be used in order to avoid mechanical breakage of this DNA, as described by Schedl et al (1993b), which disclosure is hereby incorporated by reference in its entirety.

Any one of the polynucleotides of the invention, including the Polynucleotide constructs described herein, may be introduced in an embryonic stem (ES) cell line, preferably a mouse ES cell line. ES cell lines are derived from pluripotent, uncommitted cells of the inner cell mass of pre-implantation blastocysts. Preferred ES cell lines are the following: ES-E14TG2a (ATCC No. CRL-1821), ES-D3 (ATCC No. CRL1934 and No. CRL-11632), YS001 (ATCC No. CRL-11776), 36.5 (ATCC No. CRL-11116). ES cells are maintained in an uncommitted state by culture in the presence of growth-inhibited feeder cells which provide the appropriate signals to preserve this embryonic phenotype and serve as a matrix for ES cell adherence. Preferred feeder cells are primary embryonic fibroblasts that are established from tissue of day 13- day 14 embryos of virtually any mouse strain, that are maintained in culture, such as described by Abbondanzo et al. (1993) and are growth-inhibited by irradiation, such as described by Robertson (1987), or by the presence of an inhibitory concentration of LIF, such as described by Pease and Williams (1990), which disclosures are hereby incorporated by reference in their entireties.

The constructs in the host cells can be used in a conventional manner to produce the gene product encoded by the recombinant sequence.

Following transformation of a suitable host and growth of the host to an appropriate cell density, the selected promoter is induced by appropriate means, such as temperature shift or chemical induction, and cells are cultivated for an additional period. Cells are typically harvested by centrifugation, disrupted by physical or chemical means, and the resulting crude extract retained for further purification. Microbial cells employed in the expression of proteins can be disrupted by any convenient method, including freeze-thaw cycling, sonication, mechanical disruption, or use of cell lysing agents. Such methods are well known by the skilled artisan.

Transgenic Animals

The terms "transgenic animals" or "host animals" are used herein to designate animals that have their genome genetically and artificially manipulated so as to include one of the nucleic acids according to the invention. Preferred animals are non-human mammals and include those belonging to a genus selected from *Mus* (e.g. mice), *Rattus* (e.g. rats) and *Oryctogalus* (e.g. rabbits) which have their genome artificially and genetically altered by the insertion of a nucleic acid according to the invention. In one embodiment, the invention encompasses non-human host mammals and animals comprising a recombinant vector of the invention or a GENSET gene disrupted by homologous recombination with a knock out vector.

The transgenic animals of the invention all include within a plurality of their cells a cloned recombinant or synthetic DNA sequence, more specifically one of the purified or isolated nucleic acids comprising a GENSET coding sequence, a GENSET regulatory polynucleotide, a polynucleotide construct, or a DNA sequence encoding an antisense polynucleotide such as described in the present specification.

Generally, a transgenic animal according the present invention comprises any of the polynucleotides, the recombinant vectors and the cell hosts described in the present invention. In a first preferred embodiment, these transgenic animals may be good experimental models in order to study the diverse pathologies related to the dysregulation of the expression of a given GENSET gene, in particular the transgenic animals containing within their genome one or several copies of an inserted polynucleotide encoding a native GENSET protein, or alternatively a mutant GENSET protein.

In a second preferred embodiment, these transgenic animals may express a desired polypeptide of interest under the control of the regulatory polynucleotides of the GENSET gene, leading to high yields in the synthesis of this protein of interest, and eventually to tissue specific expression of the protein of interest.

In a third preferred embodiment, these transgenic animals may express a desired polypeptide of interest fused to a GENSET signal peptide sequence, leading to the secretion of the fusion (chimeric) polypeptide.

The design of the transgenic animals of the invention may be made according to the conventional techniques well known from the one skilled in the art. For more details regarding the production of transgenic animals, and specifically transgenic mice, it may be referred to U.S. Pat. No. 4,873,191, issued Oct. 10, 1989; U.S. Pat. No. 5,464,764 issued Nov. 7, 1995; and U.S. Pat. No. 5,789,215, issued Aug. 4, 1998; these documents being herein incorporated by reference to disclose methods producing transgenic mice.

Transgenic animals of the present invention are produced by the application of procedures which result in an animal with a genome that has incorporated exogenous genetic material. The procedure involves obtaining the genetic material which encodes either a GENSET coding sequence, a GENSET regulatory polynucleotide or a DNA sequence encoding a GENSET antisense polynucleotide, or a portion thereof, such as described in the present specification. A recombinant polynucleotide of the invention is inserted into an embryonic or ES stem cell line. The insertion is preferably made using electroporation, such as described by Thomas et al. (1987), which disclosure is hereby incorporated by reference in its entirety. The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that may be used according to the invention is described by Mansour et al. (1988), which disclosure is hereby incorporated by reference in its entirety.

The positive cells are then isolated, cloned and injected into 3.5 days old blastocysts from mice, such as described by Bradley (1987), which disclosure is hereby incorporated by reference in its entirety. The blastocysts are then inserted into a female host animal and allowed to grow to term. Alternatively, the positive ES cells are brought into contact with embryos at the 2.5 days old 8–16 cell stage (morulae) such as described by Wood et al. (1993), or by Nagy et al. (1993), which disclosures are hereby incorporated by reference in their entireties, the ES cells being internalized to colonize extensively the blastocyst including the cells which will give rise to the germ line.

The offspring of the female host are tested to determine which animals are transgenic e.g. include the inserted exogenous DNA sequence and which ones are wild type.

Thus, the present invention also concerns a transgenic animal containing a nucleic acid, a recombinant expression vector or a recombinant host cell according to the invention.

Recombinant Cell Lines Derived From the Transgenic Animals of the Invention:

A further object of the invention comprises recombinant host cells obtained from a transgenic animal described herein. In one embodiment the invention encompasses cells derived from non-human host mammals and animals comprising a recombinant vector of the invention or a GENSET gene disrupted by homologous recombination with a knock out vector.

Recombinant cell lines may be established in vitro from cells obtained from any tissue of a transgenic animal according to the invention, for example by transfection of primary cell cultures with vectors expressing onc-genes such as SV40 large T antigen, as described by Chou (1989), and Shay et al. (1991), which disclosures are hereby incorporated by reference in their entireties.

Uses of Polypeptides of the Invention

Proteins Containing Multimerization Domains

The invention relates to compositions and methods using proteins of the invention containing a multimerization domains such as a leucine zipper or a helix loop helix domain.

Proteins of the invention containing a leucine zipper domain, are herein referred to as LZP, such as the ones described in this section and those containing a leucine zipper domain as shown on Table VI, or parts thereof, preferably fragments comprising a leucine zipper domain, or derivative thereof to mediate multimerization of proteins of interest.

The leucine zipper consists of a periodic repetition of leucine residues at every seventh, covering a distance spanning eight helical turns. The segments containing these periodic arrays of leucine residues appear to exist in an alpha-helical conformation, and the leucine side chains extending from one alpha-helix interact with those from a similar alpha helix of a second polypeptide, facilitating dimerization. The structure formed by cooperation of these two regions forms a coiled coil (O'Shea E. K., Rutkowski R., Kim P. S. Science 243:538–542.,1989).

Leucine-zippers contribute to targeting of various proteins (eg. glucose transporters, Asano, et al., J. Biol. Chem., 267, 19636–19641 (1992)) and permit dimerization of various cytoplasmic hormone receptors and enzymes (Forman, et al., Mol Endocrinol, 3, 1610–1626 (1989)). Leucine zippers are also a common feature of protein transcription factors, where they permit homo- or heterodimerization resulting in tight binding to DNA strands (for reviews, see Abel, et al., Nature 341, 24–25 (1989); Jones, et al., Cell 61, 9–11 (1990); Lamb, et al., Trends in Biochemical Sciences 16, 417–422 (1991)).

Leucine zippers have been shown to be useful tools in several areas of biotechnology, especially in protein engineering, where their ability to mediate homo-dimerization or hetero-dimerization has found several applications. For example, Bosslet et al have described the use of a pair of leucine zipper for in vitro diagnosis, in particular for the immunochemical detection and determination of an analyte in a biological liquid (U.S. Pat. No. 5,643,731)/Tso et al have used leucine zippers for producing bispecific antibody heterodimers (U.S. Pat. No. 5,932,448)/Methods of preparing soluble oligomeric proteins using leucine zippers have been described by Conrad et al (U.S. Pat. No. 5,965,712), Ciardelli et al (U.S. Pat. No. 5,837,816), Spriggs et al (WO9410308)/Leucine zipper forming sequences have been used by Pelletier et al in protein fragment complementation assays to detect biomolecular interactions (WO9834120). Because of their usefulness in biotechnology, it is thus highly interesting to isolate new leucine zipper domains.

The multimerization activity of proteins containing leucine zipper domains may be assayed using any of the assays known to those skilled in the art including circular dichroism spectrum and thermal melting analyses as described in U.S.

Pat. No. 5,942,433. Alternatively, the leucine zipper motif in LZP could be used by those skilled in art as a "bait protein" in a well established yeast double hybridization system to identify its interacting protein partners in vivo from cDNA library derived from different tissues or cell types of a given organism. Alternatively, LZP or part thereof could be used by those skilled in art in mammalian cell transfection experiments. When fused to a suitable peptide tag such as $[His]_6$ tag in a protein expression vector and introduced into culture cells, this expressed fusion protein can be immunoprecipitated with its potential interacting proteins by using anti-tag peptide antibody. This method could be chosen either to identify the associated partner or to confirm the results obtained by other methods such as those just mentioned.

In a preferred embodiment, the invention relates to compositions and methods of using LZP or part thereof for preparing soluble multimeric proteins, which consist in multimers of fusion proteins containing a leucine zipper fused to a protein of interest, using any technique known to those skilled in the art including those described in international patent WO9410308, which disclosure is hereby incorporated by reference in its entirety. In another preferred embodiment, LZP or derivative thereof is used to produce bispecific antibody heterodimers as described in U.S. Pat. No. 5,932,448, which disclosure is hereby incorporated by reference in its entirety. Briefly, leucine zippers capable of forming heterodimers are respectively linked to epitope binding components with different specificities. Bispecific antibodies are formed by pairwise association of the leucine zippers, forming an heterodimer which links two distinct epitope binding components. In still another preferred embodiment, LZP or part thereof or derivative thereof is used for detection and determination of an analyte in a biological liquid as described in U.S. Pat. No. 5,643,731, which disclosure is hereby incorporated by reference in its entirety. Briefly, a first leucine zipper is immobilized on a solid support and the second leucine zipper is coupled to a specific binding partner for an analyte in a biological fluid. The two peptides are then brought into contact thereby immobilizing the binding partner on the solid phase. The biological sample is then contacted with the immobilized binding partner and the amount of analyte in the sample bound to the binding partner determined. In still another preferred embodiment, the LZP or part thereof may be used to synthesize novel nucleic acid binding proteins which are able to multimerize with proteins of interest, for example to inhibit and/or control cellular growth using any genetic engineering technique known to those skilled in the art including the ones described in the U.S. Pat. No. 5,942,433, which disclosure is hereby incorporated by reference in its entirety.

In another embodiment, the invention relates to compositions and methods using the LZP or part thereof or derivative thereof in protein fragment complementation assays to detect biomolecular interactions in vivo and in vitro as described in international patent WO9834120, which disclosures is hereby incorporated by reference in its entirety. Such assays may be used to study the equilibrium and kinetic aspects of molecular interactions including protein-protein, protein-nucleic acid, protein-carbohydrate and protein-small molecule interactions, for screening cDNA libraries for binding to a target protein with unknown proteins or libraries of small organic molecules for biological activity.

Still, another object of the present invention relates to the use of the LZP or part thereof for identifying new leucine zipper domains using any techniques for detecting protein-protein interaction known to those skilled in the art. Among the traditional methods which may be employed are co-immunoprecipitation, crosslinking and co-purification through gradients or chromatographic columns of cell lysates. Once isolated as a protein interacting with the LZP, such an intracellular protein can be identified (e.g. its amino acid sequence determined) and can, in turn, be used, in conjunction with standard techniques, to identify other proteins with which it interacts. The amino acid sequence thus obtained may be used as a guide for the generation of oligonucleotide mixtures that can be used to screen for gene sequences encoding such intracellular proteins. Screening may be accomplished, for example, by standard hybridization or PCR techniques. Techniques for the generation of oligonucleotide mixtures and the screening are well-known. (See, e.g., Ausubel et al., eds., *Current Protocols in Molecular Biology*, J. Wiley and Sons (New York, N.Y. 1993) and PR Protocols: A Guide to Methods and Applications, 1990, Innis, M. et al., eds. Academic Press, Inc., New York).

Alternatively, methods may be employed which result in the simultaneous identification of genes which encode the intracellular proteins that can dimerize with the LZP or part thereof using any technique known to those skilled in the art. These methods include, for example, probing cDNA expression libraries, in a manner similar to the well known technique of antibody probing of lambda.gt11 libraries, using as a probe a labeled version of the LZP or part thereof, or fusion protein, e.g., the LZP or part thereof fused to a marker (e.g., an enzyme, fluor, luminescent protein, or dye), or an Ig-Fc domain (for technical details on screening of cDNA expression libraries, see Ausubel et al, supra). Alternatively, another method for the detection of protein interaction in vivo, the two-hybrid system, may be used.
Protein of SEQ ID NO:261 (Internal Designation 116-054-3-0-E6-CS)

The 233 amino acids protein of SEQ ID NO: 261 encoded by the cDNA of SEQ ID NO: 20 displays two leucine zipper sites at positions 142–163 and 170–191.

It is believed that the protein of SEQ ID NO: 261 is able to dimerize either with itself (homo-dimerisation) or with an heterologous protein (hetero-dimerisation) of interest, through the mediation of its leucine zipper domain. Preferred polypeptides of the invention are polypeptides comprising fragments of SEQ ID NO: 261 from position 142–163 and 170–191, and fragments having any of the biological activities described herein.
Protein of SEQ ID NO:263 (Internal Designation 116-055-2-0-F7-CS)

The protein of SEQ ID NO: 263 encoded by the cDNA of SEQ ID NO: 22 displays a leucine zipper pattern situated near its NH2 terminal part (position 15 to 36).

It is believed that the protein of SEQ ID NO: 263 is able to dimerize either with itself (homo-dimerisation) or with an heterologous protein (hetero-dimerisation) of interest, through the mediation of its leucine zipper domain. Preferred polypeptides of the invention are polypeptides comprising fragments of SEQ ID NO: 263 from position 15 to 36, and fragments having any of the biological activities described herein.
Protein of SEQ ID NO:245 (Internal Designation 105-026-1-0-A5-CS)

The protein of SEQ ID NO:245 encoded by the cDNA of SEQ ID NO:4 displays a leucine zipper pattern situated near its COOH terminal part (position 371 to 392).

It is believed that the protein of SEQ ID NO: 245 is able to dimerize either with itself (homo-dimerisation) or with an heterologous protein (hetero-dimerisation) of interest, through the mediation of its leucine zipper domain. Preferred polypeptides of the invention are polypeptides comprising fragments of SEQ ID NO: 245 from position 371 to 392, and fragments having any of the biological activities described herein.

Protein of SEQ ID NO: 257 (Internal Designation 106-043-4-0-H3-CS)

The 265-amino-acid-long protein of SEQ ID: 257 encoded by the cDNA of SEQ ID NO: 16 exhibits homology to the Homo sapiens hypothetical protein (Genbank accession number AJ278482). These two proteins are probably the result of an alternative splicing.

The protein of SEQ ID NO: 257 displays a leucine zipper pattern situated from position 155 to 176. Thus, it is believed that the protein of SEQ ID NO: 257 is able to dimerize either with itself (homo-dimerisation) or with an heterologous protein (hetero-dimerisation) of interest, through the mediation of its leucine zipper domain. Preferred polypeptides of the invention are polypeptides comprising leucine zipper domains fragments and fragments having any of the biological activities described herein.

Protein of SEQ ID NO: 314 (Internal Designation 188-41-1-0-B8-CS.cor)

A growing number of proteins have been shown to undergo post-translational modification by fatty acids that are covalently linked to cysteine residues through a thioester bond. Fatty acid modifications contribute to intracellular protein localization by facilitating membrane binding and also by strengthening protein-protein interactions. Cycles of palmitoylation and depalmitoylation have been described for a number of intracellular proteins, but the relevant enzymes that catalyze these processes have yet to be fully characterized and the full significance of these cycles remains to be elucidated.

Palmitoyl-protein thioesterase-1 (PPT1) is a lysosomal hydrolase that removes long-chain fatty acyl groups firm modified cysteine residues in proteins. Mutations in PPT1 have been found to cause the infantile form of neuronal ceroid lipofuscinosis (INCL).

Soyombo and Hofmann (J. Biol. Chem. 272: 27456–27463 [1997]) identified cDNAs encoding PPT2. The deduced PPT2 protein contains 302 amino acids, including a 27-amino acid leader peptide, a sequence motif characteristic of many thioesterases and lipases, and 5 potential N-linked glycosylation sites. PPT2 shares 18% amino acid identity with PPT1. Soyombo and Hofmann tentatively localized the human PPT2 gene to 6p21.3. Northern blot analysis detected a predominant 2.0-kb PPT2 transcript in the human tissues examined with the highest expression in skeletal muscle; variable amounts of 2.8- and 7.0-kb transcripts were also observed.

Cell fractionation studies indicate that PPT2 is present in the lysosomal fraction. Immunoblot analysis of recombinant PPT2 expressed in mammalian cells showed 6 PPT2 proteins ranging in size from 31 to 42 kDa. Treatment that removes asparagine-linked oligosaccharides resulted in a single major protein of 31 kDa and a minor protein of 33 kDa.

Recombinant PPT2, like PPT1, possesses thioesterase activity and localizes to the lysosome. Since PPT2 could not substitute for PPT1 in correcting the metabolic defect in INCL cells and was unable to remove palmitate groups from palmitoylated proteins, it appears that PPT2 possesses a different substrate specificity than PPT1. Another study, however, was able to show, after expression of the recombinant protein in a baculovirus system and using cell lysate as substrate, that the protein had S-thioesterase activity with a preference for acyl groups palmitic and myristic acid.

The subject invention provides the protein/polypeptide of SEQ ID NO:314, encoded by the cDNA of SEQ ID NO:73. The invention also provides biologically active fragments of SEQ ID NO:314. In one embodiment, the polypeptides of SEQ ID NO:314 are interchanged with the corresponding polypeptide encoded by the human cDNA of clone 188-41-1-0-B8-CS. "Biologically active fragments" are defined as those peptide or polypeptide fragments having at least one of the biological functions of the full length protein (e.g., removal of long-chain fatty acyl groups from modified cysteine residues in proteins). Compositions of the protein/polypeptide of SEQ ID NO:314, or biologically active fragments thereof, are also provided by the subject invention. These compositions may be made according to methods well known in the art.

The invention also provides variants of the protein of SEQ ID NO:314. These variants have at least about 80%, more preferably at least about 90%, and most preferably at least about 95% amino acid sequence identity to the amino acid sequence encoded by SEQ ID NO:73. Variants according to the subject invention also have at least one functional or structural characteristic of the protein of SEQ ID NO:314. The invention also provides biologically active fragments of the variant proteins. Compositions of variants, or biologically active fragments thereof, are also provided by the subject invention. These compositions may be made according to methods well known in the art. Unless otherwise indicated, the methods disclosed herein can be practiced utilizing the protein encoded by SEQ ID NO:73, biologically active fragments of SEQ ID NO:314, variants of SEQ ID NO:314, and biologically active fragments of the variants.

Because of the redundancy of the genetic code, a variety of different DNA sequences can encode the amino acid sequence of SEQ ID NO:314. In a preferred embodiment, SEQ ID NO:314 is encoded by clone 188-41-1-0-B8-CS or the cDNA of SEQ ID NO: 73. It is well within the skill of a person trained in the art to create these alternative DNA sequences which encode proteins having the same, or essentially the same, amino acid sequence. These variant DNA sequences are, thus, within the scope of the subject invention. As used herein, reference to "essentially the same" sequence refers to sequences that have amino acid substitutions, deletions, additions, or insertions that do not materially affect biological activity. Fragments retaining one or more characteristic biological activity of the protein encoded by clone 188-41-1-0-B8-CS are also included in this definition.

In one aspect of the subject invention, SEQ ID NO:314, and variants thereof, can be used to generate polyclonal or monoclonal antibodies. Both biologically active and immunogenic fragments of SEQ ID NO:314, or variant proteins, can be used to produce antibodies. Polyclonal and/or monoclonal antibodies can be made according to methods well known to the skilled artisan. Antibodies produced in accordance with the subject invention can be used in a variety of detection assays known to those skilled in the art.

SEQ ID NO:314 can be used as a marker for identification of lysosome dysfunction in individuals. In this aspect of the subject invention, antibodies specific for SEQ ID NO:314, or fragments thereof, are used in routine immunoassays to screen for the presence or absence of SEQ ID NO:314, or fragments thereof, in samples containing lysosomal contents. The presence or absence of the protein of SEQ ID NO:314 can be used to provide an indication of lysosomal function and is, thus, useful for diagnostic/prognostic identification of lysosomal dysfunction.

The subject invention also provides materials and methods for the screening of individual samples for the presence or absence of nucleic acids encoding the protein of SEQ ID NO:314, or variants thereof. In one embodiment, nucleic acids are provided for hybridization assays, known to those skilled in the art, of mRNA or cDNA. The hybridization assays are performed upon nucleic acid samples obtained, or derived from, an individual with suspected lysosomal dysfunction. The hybridization assays screen for the presence or absence of nucleic acids encoding SEQ ID NO:314, or variants thereof. The presence or absence of such nucleic acids can be used as a predictive/prognostic indicator of disease state or lysosome function.

Nucleic acids of the invention can also be used in gene replacement or gene therapy protocols. This aspect of the subject invention nucleic acids encoding SEQ ID NO:314, or biologically active fragments thereof, can be introduced into cells and implanted into an individual with lysosomal disorders. In one embodiment, genetically engineered macrophage can be used for the treatment regimen (see, for example, Eto and Ohashi [2000] J. Inherit. Metabol. Dis. 23:293–298). Alternatively, autologous cells may be obtained from an individual, transformed with nucleic acid ex vivo, expanded ex vivo, and reintroduced into the individual. Such methods are well known to the skilled artisan.
Protein of SEQ ID NO:280 (Internal Designation 160-75-4-0-A9-CS):

The protein of SEQ ID NO:280, encoded by the cDNA of SEQ ID NO:39 and expressed in the fetal brain, is a chromosome 12 paralog of C7orf2, a human protein described as a transmembrane receptor located on chromosome 7 (Heus, H. C., A. Hing, et al. (1999) Genomics 57(3): 342–51). In addition, this protein is an ortholog of the murine gene LMBR1L, found to be involved in polydactily in mice (Clark, R. M., P. C. Marker, et al. (2000) Genomics 67(1): 19–27). A high level of homology was also found with a gene identified in Fugu rubripes (AF056116), as well as with *C. Elegans* R05D3.2 (Gellner, K. and S. Brenner (1999) Genome Res 9(3): 251–8).

The 362-amino-acid-long protein of SEQ ID NO:280, encoded by the cDNA of SEQ ID NO:39 is a splice variant of Z64989, located on chromosome 12. The chromosome 12 gene has 6 known variants described in entries AK001356 and AK001651 in genbank and entries A26354, A26375, X27360 and Z64989 in geneseqn. The closest sequence is Z64989, either at the nucleotide or the protein level. Z64989 is split into 17 exons, of which the protein of the invention contains the last 14. The transcription start site of the cDNA of SEQ ID NO:39 lies within the third intron of Z64989, and the protein of the invention starts at position 128 of Z64989. In addition, 2 potential leucine zippers are present in the protein of the invention (positions 136–157 and 272–293).

Preaxial polydactyly is a congenital hand malformation that includes duplicated thumbs, various forms of triphalangeal thumbs, and duplications of the index finger. Clark et al. (supra) demonstrated the correspondence between the spatial and temporal changes in Lmbr1 expression and the embryonic onset of polydactyly mutant phenotype, suggesting that a downregulation of Lmbr1 results in polydactily. It is likely that the Lmbr1 gene is involved in the patterning of limbs during mammalian development, for example by receiving and transducing a locally secreted ligand in the developing limb.

It is believed that the protein of SEQ ID NO:280 is a paralog of human C7orf2, and is thus a membrane bound protein implicated in the patterning of the mammalian body plan during early development. For example, the protein of the invention may be involved in organizing limb development, as well as in the development of the fetal brain. As such, the activity of the present protein likely influences various cellular processes, including gene expression, cellular growth and proliferation, as well as cellular differentiation. In addition, leucine zippers within the present protein render the protein capable of undergoing specific protein-protein interactions with other leucine-zipper containing proteins, including with itself (i.e. homodimerization). Preferred polypeptides of the invention are fragments of SEQ ID NO:280 having any of the biological activities described herein.

In one embodiment of the present invention, the present protein can be used to identify cells of the fetal brain. For example, the protein of the invention or part thereof may be used to synthesize specific antibodies using any technique known to those skilled in the art. Such tissue-specific antibodies may then be used to identify tissues of unknown origin, such as in forensic samples, differentiated tumor tissue that has metastasized to foreign bodily sites, etc., or to differentiate different tissue types in a tissue cross-section using immunochemistry. In addition, labeled reagents that can specifically bind to the protein of the invention can be used to visualize cell membranes and the components of the secretory pathway in cells, e.g. the ER and Golgi.

In another embodiment of the present invention, the present protein can be used to diagnose developmental abnormalities, or the potential for such abnormalities, e.g. in a fetus or in adults to determine (i.e. to determine if they are a carrier of a mutant copy of the gene). Individuals found to carry one or two mutant copies of the present gene would be candidates for, e.g. gene therapy or other strategies to correct or compensate for the gene deficiency, or for strategies to ensure that their children would not be carriers of the mutated gene. The characterization of mutations in genes encoding the present protein would also be of great value in understanding the nature of polydactyly and other developmental disorders, thereby facilitating the development of other strategies for treating and preventing these disorders.

In another embodiment, the present protein is used to modulate gene expression, cell growth and proliferation, and/or cell differentiation in cells in vitro or in vivo. For example, any of these behaviors can be increased or inhibited in cells grown in vitro, e.g. for protein production or for ex vivo therapeutic strategies. In addition, any disease associated with an increase or decrease in any of these cellular behaviors in vivo can be treated or prevented by enhancing or inhibiting the expression or activity of the protein of the invention in cells in vivo.
Proteins of SEQ ID NOs: 309 and 304 (Internal Designations 188-11-1-0-B3-CS and 187-34-0-0-112-CS)

The proteins of SEQ ID NOs: 309 and 304 are encoded by the cDNAs of SEQ ID NOs: 68 and 63. Accordingly, it will be appreciated that all characteristics and uses of the polypeptides of SEQ ID NOs: 309 and 304 described throughout the present application also pertain to the polypeptides encoded by human cDNA of clones 188-11-1-0-B3-CS and 187-34-0-0-112-CS. In addition, it will be appreciated that all characteristics and uses of the nucleic acids of SEQ ID NOs: 68 and 63 described throughout the present application also pertain to the nucleic acids of the human cDNAs of clones 188-11-1-0-B3-CS and 187-34-0-0-112-CS.

The protein of SEQ ID NO: 309 (encoded by the clone having internal designation number 188-11-1-0-B3-CS) and the polymorphic variant thereof of SEQ ID NO: 304 (encoded by the clone having internal identification number 187-34-0-0-112-CS and which differs from the polypeptide encoded by the clone having internal designation number 188-11-1-0-B3CS at a single amino acid), are highly homologous to the first 279 amino acids of the LGI1 (Leucine-rich gene—Glioma Inactivated) protein. Clones 188-11-1-0-B3-CS and 187-34-0-0-112-CS appear to be splicing and polymorphic variants of LGI1. The LGI1 protein is 557 amino acid in length. (See Somerville et al., (2000) Mammalian Genome 11, 622–627; Chernova, et al. (1998) Oncogene 17, 2873–2881, the disclosures of which are incorporated herein by reference in their entireties). Clone 188-11-1-0-B3-CS align with the first 279 amino acids of LGI1, followed by the addition of 12 amino acids (VLREIHRFTNMS) to the C-terminal end which do not appear to be homologous to LGI1. Like LGI1, clone 188-11-1-0-B3-CS and the polymorphic variant 187-34-0-0-112-CS contain domain and are highly expressed in brain tissue.

LGI1 belongs to a large family of leucine-rich repeat (LRR) proteins. It is believed that the LRR domains act as a region of protein-protein interaction. This has been substantiated as the family of known LRR proteins has grown. Leucine-rich repeats have been identified as essential components in glycoprotein hormone receptors, proteoglycans and the Trk proteins by expression of mutants and artificial chimaeras in tissue culture and by biochemical analysis of the properties of these constructs. Many transmembrane LRR proteins are known or suspected to encode truncated forms (N and $L^6$, and slit for example) with functional significance. The proteoglycan Decorin, a secreted protein, binds TGF-β, a growth factor which stimulates decorin expression. Since decorin inhibits growth of cultured cells, it may form part of a negative feedback loop to regulate cell growth. This is similar to the proposed function of the LGI1 receptor protein.

Analysis of brain gliomas has revealed that LGI1 expression is either abolished or greatly reduced in high-grade tumors compared with more benign ones, indicating a role as a tumor suppressor gene (Cowell et al. 2000; Cowell et al. 1998, the disclosure of which is incorporated herein by reference in its entirety). Most glioblastoma multiforme (GBM) brain tumors contain only one genomic copy of LGI1, and this one is almost invariably not expressed. How the gene is inactivated is not clear, although one possibility is that chromosome or gene rearrangement, which occur in 20–25% of tumors, cause inactivation as a result of a positional effect. Recently it was determined that the LGI1 gene is located on 10q24, and is disrupted by translocation in the T98G GBM cell line and is also rearranged in over 26% of primary brain tumors. Alternatively, LGI1 may be part of a highly regulated pathway where inactivation of other key members or high specific transcription factors results in either inactivation of all genes in the pathway or a failure to initiate transcription.

Since functional inactivation of LGI1 occurs during the transition of low-grade to high-grade brain tumors, knockout or transgenic mice in which the expression of the protein of SEQ ID NO:309 or 304 has been reduced, eliminated or altered may be used as disease model. In particular, mice that overexpress LGI1 may be used as a tumorigenesis model.

Mice are particularly useful as models for assessing the consequences of altering the level or activity of the proteins of SEQ ID NO:309 or 304 or to identify agents useful in treaating tumorigenesis, since human and mouse LGI1 are highly conserved, showing 91% identity at the nucleotide level and 97% similarity at the amino acid level, with most of the amino acid substitutions being conservative. The mouse lgi1 gene is 4.2 kb in length, while the human LGI1 is 2.2 kb in length. This difference in size between the human and mouse gene is a result of the inclusion of a 2 kb sequence in the 3' untranslated region in the mouse gene. Whether the additional sequence affects gene expression is not clear. Further analysis of the genomic sequence reveals that the number of exon/intron boundaries is also similar in humans and mice. The high degree of LGI1 conservation between mice and humans implies that this gene has experienced a strong selection pressure. It is intriguing to speculate that any major deviations in the primary protein sequence may result in a loss of function of this gene product. Total or partial loss of the LGI1 gene function could, therefore, be lethal, which in turn implies that LGI1 plays an important role in normal brain development as well as in tumor formation.

SEQ ID NOs:309 and 304 also have high homology with Slit, a secreted *Drosophila* protein which plays a role in the development of axon pathway development in the central nervous system. The Slit protein is necessary for the normal development of the midline on the CNS, particularly the midline glial cells, and for the concomitant formation of the commissural axon pathway. The process is dependent on the level of Slit protein expression. It appears that the Slit protein is excreted by the midline glial cells, where it is synthesized and is eventually associated with the surface axons that traverse them. Contact of cells with supernatant expressing the product of this gene increases the permeability of THP-1 monocyte cells to calcium. Thus, it is likely that Slit is involved in a signal transduction pathway that is initiated when Slit protein binds a receptor on the surface of the monocyte cell.

In view of the above, it is believed that the proteins of SEQ ID NOs:309 and 304 are involved in a signal transduction pathway mediated through a receptor that modulates the differentiation and/or proliferation of cells.

Northern blot analysis detects LGI1 transcripts only in brain, neural tissue, and skeletal muscle but not in heart, kidney, lung, placenta, liver, or pancreas. Northern blot analysis of RNA derived from several different regions of human brain revealed a widespread expression of LGI1 although with different intensities. The highest abundance was found in cerebral cortex, hippocampus, and putamen. The lowest expression was detected in corpus callosum. The levels of expression were intermediate in the other brain regions. Accordingly, the proteins of SEQ ID NOs:309 or 304 or fragments thereof, as well as polynucleotides encoding the proteins of SEQ ID NOs:309 or 304, may be used to determine whether a tissue sample is derived from brain (and in particular cerebral cortex, hippocampus, or putamen), neural tissue, and skeletal tissue or to distinguish whether a tissue sample is derived from brain or another tissue, such as heart, kidney, lung, placenta, liver, or pancreas.

Accordingly, the present invention includes the use of the protein of SEQ ID NOs: 309 or 304, fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition, such as those listed above, in an individual. In such embodiments, the protein of SEQ ID NO:309 or 304, or a fragment thereof, is administered to an individual in whom it is desired to increase or decrease any of the activities of the protein of SEQ ID NO:309 or 304, including tumor suppression, modulation of neural development or involvement in brain tumors, glioblastoma multiforme, brain injuries, neurodegenerative disease states and behavioral disorders such as Alzheimers Disease, Parkinsons Disease, epilepsy, multiple sclerosis, Huntingtons Disease, schizophrenia, obsessive compulsive disorders, and in the processes of nerve regeneration in spinal cord injury, stroke, facial nerve damage, diabetes caused nerve damage, and retinal regeneration.

The protein of SEQ ID NO:309 or 304 or a fragment thereof may be administered directly to the individual or, alternatively, a nucleic acid encoding the protein of SEQ NO:309 or 304 or a fragment thereof may be administered to the individual. Alternatively, an agent which increases the activity of the protein of SEQ ID NO:309 or 304 may be administered to the individual. Such agents may be identified by contacting the protein of SEQ NO:309 or 304 or a cell or preparation containing the protein of SEQ ID NO:309 or 304 with a test agent and assaying whether the test agent increases the activity of the protein. For example, the test agent may be a chemical compound or a polypeptide or peptide.

Alternatively, the activity of the protein of SEQ ID NO:309 or 304 may be decreased by administering an agent which interferes with such activity to an individual. Agents which interfere with the activity of the protein of SEQ ID NO:309 or 304 may be identified by contacting the protein or a cell or preparation containing the with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify tissues, preferably brain, or to distinguish between two or more possible sources of a tissue sample on the basis of the level of the protein of SEQ ID NO:309 or 304 in the sample. For example, the protein of SEQ ID NO:309 or 304 or fragments thereof may be used to generate antibodies using any techniques known to those skilled in the art, including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry. In such methods a tissue sample is contacted with the antibody, which may be detectably labeled, under conditions which facilitate antibody binding. The level of antibody binding to the test sample is measured and compared to the level of binding to control cells from brain or tissues other than brain to determine whether the test sample is from brain. Alternatively, the level of the protein of SEQ ID NO:309 or 304 in a test sample may be measured by determining the level of RNA encoding the protein of SEQ ID NO:309 or 304 in the test sample. RNA levels may be measured using nucleic acid arrays or using techniques such as in situ hybridization, Northern blots, dot blots or other techniques familiar to those skilled in the art. If desired, an amplification reaction, such as a PCR reaction, may be performed on the nucleic acid sample prior to analysis. The level of RNA in the test sample is compared to RNA levels in control cells from brain or tissues other than brain to determine whether the test sample is from brain. For a number of disorders listed above, particularly of the nervous system, expression of the genes encoding the polypeptide of SEQ ID NO:309 or 304 at significant higher or lower levels may be routinely detected in certain tissues or cell types (e.g., cancerous and wounded tissues) or bodily fluids (e.g., serum, plasma, synovial fluid, and spinal fluid) or another tissue of cell sample taken from an individual having such a disorder, relative to the standard gene expression level, i.e., the expression level in healthy tissue or bodily fluid from an individual not having the disorder.

In another embodiment, antibodies to the protein of SEQ ID NO:309 or 304 or part thereof may be used for detection, enrichment, or purification of cells expressing the protein of SEQ ID NO:309 or 304, including using methods known to those skilled in the art. For example, an antibody against the protein of SEQ ID NO:309 or 304 or a fragment thereof may be fixed to a solid support, such as a chromatograpy matrix. A preparation containing cells expressing the protein of SEQ ID NO:309 or 304 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:309 or 304 or a fragment thereof may be used to diagnose disorders associated with altered expression of the protein of SEQ ID NO:309 or 304. In some embodiments, the protein of SEQ ID NO:309 or 304 or fragments thereof may be used to diagnose cancer. In such techniques, the level of the protein of SEQ ID NO:309 or 304 in an ill individual is measured using techniques such as those described herein and compared to the level in normal individuals. For example, a decreased level of the protein of SEQ ID NO:309 or 304 relative to normal individuals suggests that the ill individual may suffer from cancer or be predisposed to getting cancer in the future.

Another embodiment of the present invention is a polypeptide comprising a structural or functional domain of the protein of SEQ ID NO:309 or 304. Such structural or functional domains of the protein of SEQ ID NO:309 or 304 include a leucine rich repeat C-terminal domain located between amino acid positions 173 and 222, a leucine rich repeat located between amino acid positions 92 and 115, a leucine rich repeat located between amino acid positions 116 and 139, a leucine rich repeat located between amino acid positions 140 and 163, a leucine rich repeat located between amino acid positions 164 and 185, a membrane spanning segment located between amino acid positions 15 and 35, and a signal peptide comprising the sequence FLCLLSALLLTEG/KK.

Accordingly, the protein of SEQ ID NO:309 or 304 or fragments thereof, or polynucleotides encoding these proteins or fragments, may be used in in vitro diagnostic assays for malignant brain tumors, such as glioblastoma muliforme. These proteins or nucleic acids may also be used in the attenuation/prevention and/or treatment of brain tumors and/ or brain injuries, of neurodegenerative disease states and behavioral disorders such as Alzheimers Disease, Parkinsons Disease, epilepsy, multiple sclerosis, Huntingtons Disease, schizophrenia, obsessive compulsive disorders, and in the processes of nerve regeneration in spinal cord injury, stroke, facial nerve damage, diabetes caused nerve damage, and retinal regeneration.

In addition, the protein, as well as, antibodies directed against the protein, and relevant small molecules may be used as tumor markers and/or immunotherapy targets for the above disease states. For example, antibodies directed against amino acids VLREIHRFTNMS of both clones may aid in the differential detection of the secreted and receptor forms of this protein, since the proteins of SEQ ID NOs:309 and 304 have homology to the secreted forms of LGI1. In addition, the proteins of SEQ ID NOs:309 and 304 or fragments thereof may be used to identify binding partners as described herein.

DNA-binding Proteins

The invention relates to compositions and methods using proteins of the invention containing a DNA-binding domain, herein referred to as DBP, such as the ones described in this section and those containing a DNA binding domain domain as shown on Table VI, or parts thereof, preferably fragments comprising a DNA binding domain, or derivative thereof.

Transcriptional regulation is primarily achieved by the sequence-specific binding of proteins to DNA and RNA. Of the known protein motifs involved in the sequence specific recognition of DNA, the zinc finger protein is unique in its modular nature. Zinc finger domains are found in numerous zinc binding proteins which are involved in protein-nucleic acid interactions. They are independently folded zinc-containing mini-domains which are used in a modular repeating fashion to achieve sequence-specific recognition of DNA (Klug 1993 Gene 135, 83–92). Such zinc binding proteins are commonly involved in the regulation of gene expression, and usually serve as transcription factors (see U.S. Pat. Nos. 5,866,325; 6,013,453 and 5,861,495).

To date, zinc finger proteins have been identified which contain between 2 and 37 modules. More than two hundred proteins, many of them transcription factors, have been shown to possess zinc fingers domains. Zinc fingers connect transcription factors to their target genes mainly by binding to specific sequences of DNA. Zinc finger modules are found in a wide variety of transcription regulatory proteins in eukaryotic organisms. A zinc finger domain is generally composed of 25 to 30 amino acid residues which form one or more tetrahedral ion binding sites. The binding sites contain four ligands consisting of the sidechains of cysteine, histidine and occasionally aspartate or glutamate. The binding of zinc allows the relatively short stretches of polypeptide to fold into defined structural units which are well-suited to participate in macromolecular interactions (Berg, J. M. et al. (1996) Science 271:1081–1085). The zinc finger domain was first recognized in the transcription factor TFfIIIA from *Xenopus* oocytes (Miller, et al., EMBO, 4:1609–1614, 1985; Brown, et al., FEBS Lett., 186:271–274, (1985)).

Zinc binding domains which contain a $C_3HC_4$ sequence motif are known as RING domains (Lovering, R. et al. (1993) Proc. Natl. Acad. Sci. USA 90:2112–2116). The RING domain consists of eight metal binding residues, and the sequences that bind the two metal ions overlap (Barlow, P. N. et al. (1994) J. Mol. Biol. 237:201–211). Functions of RING finger proteins are mediated through DNA binding and include the regulation of gene expression, DNA recombination, and DNA repair (see Borden and Freemont, Curr Opin Struct Biol 6:395–401 (1996) and U.S. Pat. No. 5,861,495).

Both the RING finger and the LIM domain mediate protein-protein interactions and are involved in transcriptional control, either by directly affecting transcription or recruiting co-activators or co-repressors. LIM domains also contribute to various signalling pathways. They may interact with protein kinases and anchor gene products to large protein complexes or to cellular compartments.

PHD fingers are $C_4HC_3$ zinc fingers spanning approximately 50–80 residues and distinct from RING fingers or LIM domains. They are thought to be mostly DNA or RNA binding domain but may also be involved in protein-protein interactions (for a review see Aasland et al, Trends Biochem Sci 20:56–59 (1995)). The PHD finger domain, belonging to zinc finger domain family, is found in many regulatory proteins which are frequently associated with chromatin-mediated transcriptional regulation.

The nucleic acid binding activity of DBP or part thereof may be assayed using any of the assays known to those skilled in the art including those described in U.S. Pat. No. 6,013,453.

The invention relates to compositions and methods using DBPs or part thereof, especially fragments comprising a DNA-binding domain, to stimulate gene transcription.

One of the remarkable features of activation domains of transcriptional factors in general is that "fusing" them to heterologous protein domains seldom affects their ability to activate transcription when recruited to a wide variety of promoters. The high degree of functional independence exhibited by these activation domains makes them valuable tools in various biological assays for analyzing gene expression and protein—protein or protein-RNA or protein-small molecule drug interactions. Several strategies to improve the potency of activation domains and thereby the expression of genes under their control have been reported. These approaches generally involve increasing the number of copies of activation domains fused to the DNA binding domain or generating activators containing synergizing combinations of activation domains.

Therefore, in an additional embodiment, this invention provides compositions and methods containing new transcription factors comprising DBP or part thereof, preferably fragments containing DNA-binding domains. Such transcription factors may be designed to regulate the expression of target genes of interest. Aspects of the invention are applicable to systems involving either covalent or non-covalent linking of the transcription activation domain to a DNA binding domain. In practice, cells can be engineered by the introduction of recombinant nucleic acids encoding the fusion proteins containing at least two mutually heterologous domains, one of them being the DNA-binding domain of the invention, and in some cases additional nucleic acid constructs, to render them capable of ligand-dependent regulation of transcription of a target gene. Administration of the ligand to the cells then regulates (positively, or in some cases, negatively) target gene transcription (all laboratory methods related to this embodiment are completely described in U.S. Pat. No. 6,015,709, which disclosure is hereby incorporated by reference in its entirety). Illustrative (non-limiting) example of heterologous domains which can be included along with a DNA-binding domain in various fusion proteins of this invention include another transcription regulatory domains (i.e., transcription activation domains such as a p65, VP16 or AP domain; transcription potentiating or synergizing domains; or transcription repression domains such as an ssn-6/TUP-1 domain or Kruppel family suppressor domain); a DNA binding domain such as a GAL4, lex A or a composite DNA binding domain such as a composite zinc finger domain or a ZFHD1 domain; or a ligand-binding domain comprising or derived from (a) an immunophilin, cyclophilin or FRB domain; (b) an antibiotic binding domain such as tetR: or (c) a hormone receptor such as a progesterone receptor or ecdysone receptor. A wide variety of ligand binding domains may be used in this invention, although ligand binding domains which bind to a cell permeant ligand are preferred. It is also preferred that the ligand have a molecular weight under about 5 kD, more preferably below 2.5 kD and optimally below about 1500 D. Non-proteinaceous ligands are also preferred. Examples of ligand binding domain/ligand pairs that may be used in the practice of this invention include, but are not limited to: FKBP:FK1012, FKBP:synthetic divalent FKBP ligands (see WO 96/0609 and WO 97/31898), FRB:rapamycin/FKBP (see e.g., WO 96/41865 and Rivera et al, "A humanized system for pharmacologic control of gene expression", Nature Medicine 2(9):1028–1032 (1997)), cyclophilin:cyclosporin (see e.g. WO 94/18317), DHFR:methotrexate (see e.g. Licitra et al, 1996, Proc. Natl. Acad. Sci. U.S.A. 93:12817–12821), TetR:tetracycline or doxycycline or other analogs or mimics thereof (Gossen and Bujard, 1992, Proc. Natl. Acad. Sci. U.S.A. 89:5547; Gossen et al, 1995, Science 268:1766–1769; Kistner et al, 1996, Proc. Natl. Acad. Sci. U.S.A. 93:10933–10938), a progesterone receptor:RU486 (Wang et al, 1994, Proc. Natl. Acad. Sci. U.S.A. 91:8180–8184), ecodysone receptor:ecdysone or muristerone A or other analogs or mimics thereof (No et al, 1996, Proc. Natl. Acad. Sci. U.S.A. 93:3346–3351) and DNA gyrase:coumermycin (see e.g. Farrar et al, 1996, Nature 383:178–181). In many applications it is preferable to use a DNA binding domain which is heterologous to the cells to be engineered. In the case of composite DNA binding domains, component peptide portions which are endogenous to the cells or organism to be engineered are generally preferred.

In another aspect of this embodiment, polynucleotides encoding DNA-binding domains as well as any other functional fragments of DBP may be introduced into polynucleotides encoding fusion proteins for a variety of regulated gene expression systems, including both allostery-based systems such as those regulated by tetracycline, RU486 or ecdysone, or analogs or mimics thereof, and dimerization-based systems such as those regulated by divalent compounds like FK1012, FKCsA, rapamycin, AP1510 or coumermycin, or analogs or mimics thereof, all as described below (See also, Clackson, Controlling mammalian gene expression with small molecules, Current Opinion in Chem. Biol. 1:210–218 (1997)). The fusion proteins may comprise any combination of relevant components, including bundling domains, DNA binding domains, transcription activation (or repression) domains and ligand binding domains. Other heterologous domains may also be included.

Another embodiment of this invention relates to expression systems, preferably vectors and vector-containing cells, using DBP or part thereof, especially the DNA-binding domain. In this regard, recombinant nucleic acids are provided which encode fusion proteins containing the transcription activation domain of the invention and at least one additional domain that is heterologous thereto, where the peptide sequence of said activation domain is itself eventually modified relative to the naturally occurring sequence from which it was derived to increase or decrease its potency as a transcriptional activator relative to the counterpart comprising the native peptide sequence. Each of the recombinant nucleic acids of this invention may further comprise an expression control sequence operably linked to the coding sequence and may be provided within a DNA vector, e.g., for use in transducing prokaryotic or eukaryotic cells. Some of the recombinant nucleic acids of a given composition as described above, including any optional recombinant nucleic acids, may be present within a single vector or may be apportioned between two or more vectors. The recombinant nucleic acids may be provided as inserts within one or more recombinant viruses which may be used, for example, to transduce cells in vitro or cells present within an organism, including a human or non-human mammalian subject. It should be appreciated that non-viral approaches (naked DNA, liposomes or other lipid compositions, etc.) may be used to deliver recombinant nucleic acids of this invention to cells in a recipient organism. The resultant engineered cells and their progeny containing one or more of these recombinant nucleic acids or nucleic acid compositions of this invention may be used in a variety of important applications, including human gene therapy, analogous veterinary applications, the creation of cellular or animal models (including transgenic applications) and assay applications. Such cells are useful, for example, in methods involving the addition of a ligand, preferably a cell permeant ligand, to the cells (or administration of the ligand to an organism containing the cells) to regulate expression of a target gene.

The invention also relates to methods and compositions using DBP or part thereof to bind to nucleic acids, preferably DNA, alone or in combination with other substances. For example, DBP or part thereof is added to a sample containing nucleic acid in conditions allowing binding, and allowed to bind to nucleic acids. In a preferred embodiment, DBP or part thereof may be used to purify nucleic acids such as restriction fragments. In another preferred embodiment, DBP or part thereof may be used to visualize nucleic acids when the polypeptide is linked to an appropriate fusion partner, or is detected by probing with an antibody. Alternatively, DBP or part thereof may be bound to a chromatographic support, either alone or in combination with other DNA binding proteins, using techniques well known in the art, to form an affinity chromatography column. A sample containing nucleic acids to purify is run through the column. Immobilizing DBP or part thereof on a support advantageous is particularly for those embodiments in which the method is to be practiced on a commercial scale. This immobilization facilitates the removal of the protein from the batch of product and subsequent reuse of the protein. Immobilization of DBP or part thereof can be accomplished, for example, by inserting a cellulose-binding domain in the protein. One of skill in the art will understand that other methods of immobilization could also be used and are described in the available literature.

In another embodiment, the present invention relates to compositions and methods using DBP or part thereof, especially the DNA-binding domain, to alter the expression of genes of interest in a target cells. Such genes of interest may be disease related genes, such as oncogenes or exogenous genes from pathogens, such as bacteria or viruses using any techniques known to those skilled in the art including those described in U.S. Pat. Nos. 5,861,495; 5,866,325 and 6,013,453.

In still another embodiment, DBP or part thereof may be used to diagnose, treat and/or prevent disorders linked to dysregulation of gene transcription such as cancer and other disorders relating to abnormal cellular differentiation, proliferation, or degeneration, including hyperaldosteronism, hypocortisolism (Addison's disease), hyperthyroidism (Grave's disease), hypothyroidism, colorectal polyps, gastritis, gastric and duodenal ulcers, ulcerative colitis, and Crohn's disease.

Protein of SEQ ID NO: 388 (Internal Designation 109-002-4-0-C6-CS)

The protein of SEQ ID NO: 388 encoded by cDNA of SEQ ID NO: 147 is a 375 amino-acids long protein containing a zinc finger domain, namely a PHD-finger domain from positions 329 to 339.

The PHD finger was originally identified by comparison of the maize homeodomain (HD) protein ZMHOX1a (Bellmann R. and Werr W. EMBO J. 11: 3367–3374 (1992)) to its Arabidopsis relative HAT3.1 and named plant homeodomain (PHD) finger due to its association with the DNA-binding HD in both genes. This motif often occurs in various regulatory genes, such as members of the trithorax (TRX-G) or polycomb (PC-G) groups (Aasland R. et al. Trends Biochem.Sci. 20: 56–59 (1995)) and leukaemia-associated proteins (LAP finger) (Saha V. et al. Proc.Natl.Acad.Sci. USA 92: 9737–9741 (1995)). The established function of TRX-G and PC-G genes in chromatin modulation in *Droso-*

*phila* led to the suggestion that the PHD finger is involved in chromatin-mediated transcriptional control. Recent data provide evidence that PHD finger proteins are associated with chromatin remodelling complexes (Bochar D. A. et al. Proc.Natl.Acad.Sci. USA 97: 1038–1043 (2000)) or contribute to histone acetylation (Loewith R. et al. Mol.Cell.Biol. 20: 3807–3816 (2000)). Based on the position of the unique His residue, the cysteine scaffold of the PHD finger (Cys4-His-Cys3) is clearly distinct from RING fingers (Cys3-His-Cys4) and LIM domains (Cys2-His-Cys5) and from DRIL domains, where two RING finger motifs are closely linked. In contrast to the accumulating knowledge about LIM domains, functional data concerning the PHD finger remain rare (see rev. Halbach T. et al. Nucleic Acids Research 28: 3542–3550 (2000)).

GYMNOS, a recently described member of the SWI2/SNF2 protein family in plants (22), also contains a PHD finger and takes part in the control of development. The second PHD finger motif of *Drosophila* dMI-2 protein (a reference for animal counterparts) shares high sequence conservation to known plant PHD fingers. Due to the similarity to the *Drosophila* MI-2 gene, GYMNOS has been implicated in chromatin modulation. While the PHD finger is an isolated motif in GYMNOS, the characteristic Cys4-His-Cys3 scaffold in PHDf-HD plant genes is embedded in a large region. This region shares 60% identical residues between seven genes of different plant species and is more highly conserved than the HD (40%). This conservation suggests that the PHD finger is part of a larger functional unit. When combined with a leucine zipper in the surrounding conserved 180 amino acid region in the PHDf-HD proteins, PHD finger activity is masked and silenced. The leucine zipper upstream of the PHD finger mediates interactions with helix 4 of plant 14-3-3 proteins, thus identifying PHDf-HD proteins as potential targets of 14-3-3 signalling pathways. The 14-3-3 family of multifunctional proteins is highly conserved between animals, plants and yeast. Due to the dimeric nature of 14-3-3 proteins and their capacity to form homo- and heterodimers, members of the 14-3-3 protein family function as scaffolds promoting association of protein complexes. 14-3-3 proteins are involved in various signalling pathways that include, for example, Raf, BAD, Bcr/Bcr-Abl, KSR (kinase supressor of Ras), PKC, PI-3 kinase and cdc25C phosphatase. Others enter the nucleus and are associated with DNA-binding complexes. Recent data even indicate contacts to TBP, TFIIB and the human TBP-associated factor hTAF(II)32 (for rev. see Halsbach T., supra).

Recently PHD finger has been shown to activates transcription in yeast, plant and animal cells. Transcriptional activation in animal cells (in the zebrafish embryo as a test system) tested for different PHD fingers seems to be a general feature of the PHD finger motif in eukaryotic cells.

It remains to be elucidated whether the PHD finger directly interacts with a component of the transcription initiation complex or if its positive effect on transcription is mediated via auxiliary protein interactions. Both assumptions, however, involve PHD finger-mediated protein-protein interactions. Surrounding sequences may interfere sterically with accession of the PHD finger and its exposure could eventually depend on binding of a protein partner.

The PHD finger containing proteins appear to be involved in human diseases. Studies on the AIRE gene from humans (Nagamine K. et al. Nat.Genet. 17: 393–398 (1997), Scott H. S. et al. Mol.Endocrinol. 12: 1112–1119 (1998)) have shed more light on the importance of this motif, since all clinically significant mutations in the AIRE gene coincide with alteration in two PHD fingers, resulting in the rare autoimmune polyendocrinopathy-candidiasis-ectodermal dystrophy (APECED). The presence of PHD fingers in genes up-regulated in leukaemia, associated with the autoimmune disease APECED or participating in euchromatin to heterochromatin modulation, like the TRX-G or PC-G genes, indicates that this motif may be involved in a variety of important cellular events including developmental disorders, tumors and immune diseases. For exemple, the role of a chromatin structure remodelling in cancer metastasis and tissue carcinogenesis is well documented (Zhang Y. et al. Cell 16: 279–289 (1998); Klugbauer S. and Rabes H. M. Oncogene 29: 4388–4393 (1999)).

It is believed that the protein of SEQ ID NO: 388 or part thereof is a zinc binding protein, preferably able to bind nucleic acids, more preferably a transcription factor. Preferred polypeptides of the invention are polypeptides comprising the amino acids of SEQ ID NO: 388 from positions 329 to 339. Other preferred polypeptides of the invention are fragments of SEQ ID NO: 388 having any of the biological activity described herein.

In one embodiment of the invention, the protein of the invention, or part thereof, or derivative thereof, may be used to a subject to diagnose developmental disorders and/or cell proliferative disorders linked to dysregulation of gene expression mediated by the PHD-finger domain of the protein of the invention. Such disorders include but are not limited to, renal tubular acidosis, anemia, Cushing's syndrome, achondroplastic dwarfism, epilepsy, gonadal dysgenesis, hereditary neuropathies such as Charcot-Marie-Tooth disease and neurofibromatosis, hypothyroidism, hydrocephalus, seizure disorders such as Syndenham's chorea and cerebral palsy, spinal bifida, and congenital glaucoma, cataract, sensorineural hearing loss, benign tumors, and cancers such as adenocarcinoma; leukemia; melanoma; lymphoma; sarcoma; and cancers of the bladder, colon, liver, brain, small intestine, large intestine, breast, ovary, kidney, lung, and prostate. Diagnosis may be performed using nucleic acids or antibodies able to detect the expression of the protein of the invention using any technique known to those skilled in the art including Northern blotting, RT-PCR, immunoblotting methods immunohistochemisty, enzyme-linked immunosorbant assay (ELISA) described herein. Quantities of the protein of the invention expressed in subject samples, control and disease from biopsied tissues or body fluids or cell extracts taken from patients are compared with the standard values. Deviation between standard and subject values establishes the parameters for diagnosing disease.

In another embodiment, antagonists or inhibitors of the protein of the invention or part thereof may be administered to patients to treat and/or prevent the above referred disorders. Antagonists or inhibitors of transcriptional activators may indeed be used to suppress transcriptional activation in tumor cells. Such antagonists and/or inhibitors may be antibodies specific for the protein of the invention that can be used directly as an antagonist, or indirectly as a targeting or delivery mechanism for bringing a pharmaceutical agent to cells or tissue which express the protein of the invention. Neutralizing antibodies, (i.e., those which inhibit protein-protein interactions) are especially preferred for therapeutic use. Other methods to inhibit the expression of the protein of the invention include antisense and triple helix stategies as described herein. Other antagonists or inhibitors of the protein of the invention may be produced using methods which are generally known in the art, including the screening of libraries of pharmaceutical agents to identify those which specifically bind the protein of the invention. The protein of the invention, or part thereof, preferably its functional or immunogenic fragments, or oligopeptides related thereto, can be used for screening libraries of compounds in any of a variety of drug screening techniques. The fragment employed in such screening may be free in solution, affixed to a solid support, borne on a cell surface, or located intracellularly. The formation of binding complexes, between the protein of the invention, or part thereof, or derivative thereof, and the agent being tested, may be measured. Another technique for drug screening which may be used provides for high throughput screening of compounds having suitable binding affinity to the protein of the invention as described in published PCT application WO84/03564.

Protein of SEQ ID NO: 394 (Internal Designation 157-17-2-0-C1-CS)

The protein of SEQ ID NO:394 encoded by the extended cDNA SEQ ID NO:153 contains a myc-type, helix-loop-helix dimerization domain (Prosite PS00038) from amino acid position 13 to 28 and has no adjacent basic domain. Using the Schiffer-Edmundson helical wheel diagram (Schiffer et al. (1967) Biophys.J. 7:121–135), a hypothetical amphipatic alpha helix is predicted between position 53 and position 68. Three hydrophobic amino acids, Val 55, Phe59 and Ile63, are aligned on the same side of the helix to present a hydrophobic interaction surface and three hydrophilic residues (Tyr53, Gln62 and Ser64) are presented on the other side of helix. There is no Proline residue within the stretch to disrupt the continuity of the alpha helix. Thus, these structural features in the protein of the invention indicates that this protein could be a novel member of the nonbasic "helix-loop-helix" subfamily (HLH) of transcription regulator.

The helix-loop-helix (HLH) family of transcriptional regulators is involved in the control of different cellular differentiation phenomenon such as neurogenesis, haematopoiesis, myogenesis and angiogenesis. The HLH proteins are found in all eukaryotic organisms ranging from yeast saccharomyces cerevisiae to human (Reviewed by Massari ME and Murre C. (2000) Molecular and Cellular Biology, 20 (2):429–440). The HLH proteins bind DNA as dimers, and different members of HLH family bind either as homodimers or as heterodimers with other members of the family. The presence in a cell of a large repertoire of distinct complexes that can bind to a particular DNA sequence element suggests that competition for DNA binding may play a regulatory role.

Members of the helix-loop-helix (HLH) family of transcriptional regulation proteins share a common structural element, i.e. a stretch of 40–50 amino acids containing two short amphipathic alpha-helices separated by a linker region (the loop) of varying length (Murre C et al. (1989) Cell 56:777–783). This element was initially identified as a region of homology among c-myc, the muscle determination gene MyoD (Davis R L et al. (1987) Cell 51:987–1000) and the Drosophila achaete-scute complex (AS-C) involved in neural determination (Villares R. and Cabrera C V (1987) Cell 50:415–424). The HLH proteins form both homodimers and heterodimers by means of interaction between the hydrophobic residues on the corresponding faces of the two helices to give a parallel four-helix bundle structure (Adrian R et al. (1993) Nature, 363:38–45; Ellenberger T et al. (1994) Genes Dev. 8:970–980). The alpha helical regions are usually 15–16 amino acids long with hydrophobic residues at every third and fourth position, and each helix contains several conserved residues (Murre C et al. (1989) Cell, 56:777–783; Benezra R. et al. (1990) Cell, 61:49–59).

The HLH protein family is subdivided into two major groups: the so-called "bHLH" and "non basic HLH" subfamilies. Proteins of the bHLH family contain a conserved highly basic region immediately N-terminal to the first helix (known as bHLH structure), and mutagenesis experiments on MyoD protein confirm that this region is responsible for sequence-specific binding to the "E-box", a consensus DNA motif for bHLH proteins (Davis R L. et al. (1990) Cell, 60: 733–746). A dimeric bHLH protein (either homodimeric or heterodimeric but in which both subunits contains a basic region) are able to bind to DNA. In general, the bHLH proteins fall into two categories: Class A consists of proteins that are ubiquitously expressed, including mammalian E12/E47 and fly da whereas the class B consists of proteins that are expressed in a more tissue-specific manner, including mammalian MyoD and fly AC-S. In most cases, the tissue-specific bHLH proteins preferentially heterodimerize with ubiquitous partners.

The non basic HLH subfamily contains proteins lacking a basic region unable to bind to DNA but that could form homo- or heterodimers through their HLH motif. Indeed, heterodimeric complexes between non basic HLH and bHLH proteins fail to bind to DNA and negatively modulate the bHLH proteins-mediated transcription activation. This phenomenon was first demonstrated in a MyoD/Id regulation model (Benezra R. et al. (1990) Cell, 61:49–59). The MyoD gene product is able to activate previously silent muscle-specific genes when introduced into a large variety of differentiated cell types. MyoD proteins form either homodimers or heterodimers with other bHLH proteins such as E12 or E47, and bind to E-box consensus motif to activate myogenesis. The Id gene, conserved from batracians to mammals (Wilson R et al. (1995) Mech.Dev. 49:211-222; Sawai S et al. (1997) Mech.Dev. 65:175–185; Norton J D et al. (1998) trends in Cell Biology 8:58–65), lacks a basic region adjacent to its HLH motif but is able to specifically dimerize with either MyoD, E12 or E14 and has been shown to subsequently attenuate the heterodimer's ability to bind DNA. Additionally, overexpression of Id inhibits MyoD-dependent gene activation in in vivo transfection experiments. Id proteins may function either to repress directly the activity of tissue-restricted bHLH proteins by rendering them non-functional or, more likely, to sequestrate the ubiquitous bHLH proteins and preventing them from forming active heterodimers with the tissue-restricted bHLH (Review by Norton J D et al. (1998) trends in Cell biology 8:58–65).

The possibility that the Id protein behaves as a dominant-negative regulator to repress MyoD protein activity through the formation of nonfunctional heterodimeric complexes is considerably strengthened by the following findings in Drosophila. In Drosophila, the development of peripheral nervous system is positively regulated by the two structurally related bHLH proteins, AS-C and daughterless (da), since loss of either activity results in loss of sensory organ development. The extramacrochactac Emc product belonging to the non basic HLH subfamily was shown to antagonize the activity of AS-C and da. through the formation of nonfunctional heterodimers with the bHLH proteins (Hillary M et al. (1990) Cell,61:27–38; Garrell J et al. (1990) Cell 61,39–48).

Human Id genes including human Id1, Id2, Id3 and Id4 have been identified and localized (Review by Norton J D et al. (1998) trends in Cell Biology 8:58–65). The bHLH proteins and Id proteins are thought to be involved in the regulation of apoptosis. Differentiation and development of T- and B-lymphocytes in immune system are positively regulated by the combination of ubiquitous E proteins and lymphocyte-restricted bHLH proteins. Disruption in gene expression from either class results in severe perturbation of T- and B-lymphocyte development (Bain G et al. (1997) Mol Cell Biol 17:4782–4791; Zhuang et al. (1996) Mol Cell Biol 16:2898–2905). Cell-arrested T thymocytes undergo a massive apoptosis when Id1 gene is overexpressed (Kim D (1999) Mol Cell Biol 19(12):8240–53). Overexpression of Id1 gene product also results in apoptosis in neonatal and adult cardiac myocytes in culture (Tanaka K et al. (1998) J Biol Chem 273(40) 25922–25928).

Id1 and Id3 proteins are also required to support angiogenesis. Quiescent adult endothelial cells express minimal level of the Id proteins, whereas Id expression is upregulated in angiogenic endothelial cells. Partial loss of these proteins in Id1$^{+/-}$Id3$^{-/-}$ double knockout mice impairs angiogenesis, resulting in the resistance to tumour growth (Lyden D et al. (1999) Nature 401:670–677). In addition, a significant overexpression of mRNA and protein levels of Id1, Id2 and Id3 has been found in patients with pancreatic cancer (Maruyama H et al. Am J Pathol (1999) 155(3): 815–822) A correlation of Id1 gene upregulation and aggressive phenotype of human breast cancer cells has also been reported (Lin C Q et al. (2000) Cancer Res 60(5):1332–40).

Thus, identification and cloning of members of the HLH family, and especially of the non basic HLH subfamily, is necessary to enrich our knowledge about the biological importance of the HLH transcription factors network and further more to provide insights and tools in disorders linked to dysregulation of the HLH-mediated transcription.

It is believed that the protein of SEQ ID NO: 394 or part thereof plays a role in the regulation of transcription activation, probably as a member of the HLH family, preferably of the non basic HLH subfamily. More particularly, the protein of the invention is thought to be able to antagonize the activity of members of the bHLH family through the formation of heterodimers. Preferred polypeptides of the invention are polypeptides comprising the amino acids of SEQ ID NO:394 from positions 13 to 28, from positions 53 to 68, and from positions 13 to 68. Other preferred polypeptides of the invention are fragments of SEQ ID NO: 394 having any of the biological activity described herein.

The dimerization ability of the protein of the invention or part thereof which is characteristic of the HLH family may be assayed using any of the assays known to those skilled in the art. For example, interacting protein partners, especially members of the bHLH subfamily, may be identified using screening of cDNA expression libraries as described for the identification of some HLH transcription factors such as E12 and E47 (Murre C et al. (1989) Cell 56:777–783), Max (a Myc binding factor) (Elizabeth M et al. (1991) Science 251:1217) as well as Id (Benezra C et al. (1990) Cell 61:49–59). Alternatively, the helix-loop-helix motif in the protein of the invention could be used by those skilled in art as a "bait protein" in a well established yeast double hybridization system to identify its interacting protein partners in vivo from cDNA library derived from different tissues or cell types of a given organism. Alternatively, the protein of the invention or part thereof could be used by those skilled in art in mammalian cell transfection experiments. When fused to a suitable peptide tag such as [His]$_6$ tag in a protein expression vector and introduced into culture cells, this expressed fusion protein can be immunoprecipitated with its potential interacting proteins by using anti-tag peptide antibody. This method could be chosen either to identify the associated partner or to confirm the results obtained by other methods such as those just mentioned.

An object of the invention relates to compositions and methods using the protein of the invention or part thereof to dysregulate gene transcription, preferably transcription mediated by HLH regulators either in vitro or in vivo, through overexpression of the protein of the invention using any means known to those skilled in the art.

The protein of the invention or part thereof could be used to induce apoptosis of specific cell-type under either physiological or pathological conditions. In a preferred embodiment, the apoptosis active polypeptide is added to an in vitro culture of mammalian cells in an amount effective to induce apoptosis. In another preferred embodiment, the apoptosis active polypeptide is expressed under the control of a promoter which may be activated under precise conditions. In particular, such conditional expression of an apoptosis-active polypeptide upon demand may be very useful to get rid of cells that have become unwanted, for example in applications where such cells have been used in a cellular therapy goal and have become useless. Another example of application is the case of expression under the control of a promoter that becomes active after infection by a given microorganism, thus resulting in the death of the infected cells only. Furthermore, the protein of the invention or part thereof may be useful in the diagnosis, the treatment and/or the prevention of disorders in which apoptosis is beneficial, including but not limited to disorders linked to abnormal cellular proliferation such as those described below.

In another embodiment, the protein of the invention or part thereof can be used to diagnose, treat and/or prevent disorders linked to overexpression of HLH proteins, such as cancer and other disorders relating to abnormal cellular differentiation, proliferation, or degeneration, including hyperaldosteronism, hypocortisolism (Addison's disease), hyperthyroidism (Grave's disease), hypothyroidism, colorectal polyps, gastritis, gastric and duodenal ulcers, ulcerative colitis, and Crohn's disease, neurodegenerative disorders such as Parkinson's or Alzheimer's diseases using any methods and/or techniques described herein. In addition, the protein of the invention or part thereof may be used to evaluate the disease progression and the clinical treatment efficiency. The protein of the invention or part thereof could also be used a molecular target for anti-angiogenesis drug design. Inhibition of protein expression could be achieved by many means known to those skilled in the art including those described in the present application. For example, an antisense nucleotide or triple helix strategy could be developed to block the protein synthesis. Alternatively, the expressed protein of the invention might be neutralized by using specific monoclonal antibody using techniques known to those skilled in the art including those described in Peverali F A et al (1994) EMBO J. 13:4291–4301; Barone M V et al. (1994) Proc.Natl.Acad.Sci.USA 91:4985–4988; and Haza E T et al. (1994) J.Biol.Chem. 269:2139–2145.

Protein of SEQ ID NO: 466 (Internal Designation 184-4-2-0-D3-CS)

The protein of SEQ ID NO: 466 overexpressed in liver and encoded by the cDNA of SEQ ID NO: 225 displays a Zinc finger motif of RING type (C3HC4) (Pfam signature from positions 41 to 81, Prosite signature from positions 56 to 65) and a B-box zinc finger motif (pfam signature from positions 110 to 153). In addition, the protein of the invention is predicted to have a nuclear localization.

It is believed that the protein of SEQ ID NO: 466 or part thereof is a zinc binding protein, preferably able to bind nucleic acids, more preferably a transcription factor. Preferred polypeptides of the invention are polypeptides comprising the amino acids of SEQ ID NO:466 from positions 41 to 81 (Ring Zinc finger protein), and from 110 to 153 (B-Box domain). Other preferred polypeptides of the invention are fragments of SEQ ID NO: 466 having any of the biological activity described herein.

Protein of SEQ ID NO: 267 (Internal Designation 116-111-1-0-H9-CS)

The protein of SEQ ID NO:267 encoded by the extended cDNA SEQ ID NO:26 exhibits an Emotif zinc finger domain, C2H2 type, from positions 185 to 202, and is thought to be localized in the nucleus.

It is believed that the protein of SEQ ID NO:267 or part thereof is a zinc binding protein, preferably able to bind nucleic acids, more preferably a transcription factor. Preferred polypeptides of the invention are polypeptides comprising the amino acids of SEQ ID NO:267 from positions 185 to 202. Other preferred polypeptides of the invention are fragments of SEQ ID NO:267 having any of the biological activity described herein.

Protein of SEQ ID NO: 277 (Internal Designation 160-103-1-0-F11-CS)

The protein of SEQ ID NO:277 encoded by the extended cDNA SEQ ID NO:36 exhibits a pfam DHHC zinc finger domain from positions 140 to 204.

It is believed that the protein of SEQ ID NO: 277 or part thereof is a zinc binding protein, preferably able to bind nucleic acids, more preferably a transcription factor. Preferred polypeptides of the invention are polypeptides comprising the residues of SEQ ID NO:277 from positions 140 to 204. Other preferred polypeptides of the invention are fragments of SEQ ID NO:277 having any of the biological activity described herein.

Protein of SEQ ID NO: 272 (Internal Designation 145-25-3-0-B4-CS)

The protein of SEQ ID NO:272 encoded by the extended cDNA SEQ ID NO:31 shows homology with numerous zinc binding proteins. In addition, the protein of the invention exhibits the pfam RING zinc finger signature from positions 87 to 129. The protein of SEQ ID NO:272 has a variant, i.e. the protein of SEQ ID NO:273 encoded by the extended cDNA SEQ ID NO:32 and thought to have the same function and utilities.

It is believed that the protein of SEQ ID NO:272 or part thereof is a zinc binding protein, preferably able to bind nucleic acids or proteins, more preferably a transcription factor. Preferred polypeptides of the invention are polypeptides comprising the amino acids of SEQ ID NO:272 from positions 87 to 129. Other preferred polypeptides of the invention are fragments of SEQ ID NO:272 having any of the biological activity described herein.

Hydrolases and Inhibitors

The invention relates to compositions and methods using proteins of the invention havinf an hydrolytic activity, herein referred to as HYP, such as the ones described in this section and those containing an hydrolytic domain as shown on Table VI, or parts thereof, preferably fragments comprising an hydrolytic domain, or derivative thereof.

The invention relates to methods and compositions using HYP or a fragment thereof to hydrolyze one or several substrates, alone or in combination with other substances. For example, the protein of the invention or part thereof is added to a sample containing the substrate(s) in conditions allowing hydrolysis, and allowed to catalyze the hydrolysis of the substrate(s). Hydrolyzed substrates are then detected using standard methods known to those skilled in the arts.

The protein of the invention or part thereof can also be added to samples as a "cocktail" with other hydrolytic enzymes, such as other peptidases, for example to decontaminate surgical instruments using methods described in U.S. Pat. No. 5,489,531. The advantage of using a cocktail of hydrolytic enzymes is that one is able to hydrolyze a wide range of substrates without necessarily knowing the specificity of each enzyme. Using a cocktail of hydrolytic enzymes also protects a sample from a wide range of future unknown contaminants from a vast number of sources. Alternatively, HYP or part thereof may be bound to a chromatographic support, either alone or in combination with other hydrolytic enzymes, using techniques well known to those skilled in the art, to form an affinity column to remove the substrate. Immobilization facilitates removal of the enzyme from the batch of product and subsequent reuse of the enzyme.

Immobilization of the enzyme or part thereof can be accomplished, for example, by adding a cellulose-binding domain to the protein through the modification of the DNA sequence coding for the protein or part thereof. One of skill in the art will understand that other methods of immobilization could also be used and are described in the available literature. Alternatively, the same methods may be used to identify new substrates.

In another embodiment, HYP or part thereof may be used to identify or quantify the amount of a given substrate in a biological sample. In a preferred embodiment, HYP of part thereof is catalytically inactived, i.e. capable of binding but not hydrolyzing a given substrate, using any of the methods known to those skilled in the art including those which produce a mutant enzyme, a recombinant-enzyme, or a chemically inactivated enzyme. The catalytically inactive protein of the invention is then incubated with an aliquot of a biological sample under conditions suitable for binding of the inactive enzyme to the substrate. Then, the bound enzyme is detected to assess the presence or amount of the eubacteria in the biological sample. In another preferred embodiment, HYP or part thereof is used in assays and diagnostic kits for the identification and quantification of substrates in a biological sample. These assays can be based for example, on standard enzyme-linked immunosorbant assays (ELISA) or any other technique known to those skilled in the art In addition, HYP or part thereof may be used to identify, e.g. using screens based on standard assays such as those described above, inhibitors of the enzyme for mechanistic and clinical applications. Such inhibitors may then be used to identify or quantify HYP in a sample, and to diagnose, treat or prevent any of the disorders where the protein's activity is undesirable and/or deleterious.

Protein of SEQ ID NO:400 (Internal Designation 160-54-1-0-F7-CS)

The protein of SEQ ID NO:400, encoded by the cDNA of SEQ ID NO:159, exhibits two putative transmembrane domains encompassing amino-acids 50–70 and 127–147 as predicted by the software TopPred II (Claros and von Heijne, *CABIOS applic. Notes*, 10: 685–686 (1994)). It also diplays the Prosite carboxypeptidase zinc-binding region signature PS00133 at positions 117–127. It is predicted by the psort software (see Nakai K and Horton P, *Trends Biochem Sci*. 1999 January;24(1):34–6) to localize to the nucleus with a high probability (73.9%). Finally it is specifically expressed in fetal brain and shows no homology to previously known proteins.

Carboxypeptidase enzymes hydrolyze the terminal amino acid of a protein or peptide. A novel family of carboxypeptidases, localized in the nucleus and with a carboxypeptidase-dependant transcriptional activity, has emerged only recently. Its first member, AEBP1, was previously identified as a 3T3 preadipocyte factor implicated in the repression of the aP2 gene expression. AEBP1 stands for "AE-1 Binding Protein," where AE-1 is a regulatory element of the adipose P2 gene (aP2), a gene involved in triglyceride metabolism and activated in adipocytes. Its own expression is abolished during adipocyte differentiation (He G P et al., Nature 378:92–96(1995)). AEBP1 was subsequently shown to play a similar role in the differentiation of osteoblastic cell lines (Ohno I et al., Biochem Biophys Res Commun. 1996 Nov. 12;228(2):411–4) and vascular smooth muscle cells (Layne M D et al., J. Biol. Chem. 273:15654–15660(1998)). It was proposed that AEBP1 acts as a negative transcription factor by cleaving proteins involved in transcription, a new feature in transcription regulation. Recent evidence further suggests that its transcriptional activity is itself attenuated by binding to G-proteins subunits (Park J G et al., EMBO J. 1999 Jul. 15;18(14):4004–12) and stimulated by DNA binding (Muise A M and Ro H S, Biochem J. 1999 Oct. 15;343 Pt 2:341–5).

It is believed that the protein of SEQ ID NO:400 plays a role in cell signaling, nuclear transcriptional activity and in the differentiation of several cell types, especially those found in the developing brain (including but not limited to neurons). Preferred polypeptides of the invention are polypeptides having any of the biological activities described herein.

One embodiment of the present invention relates to compositions and methods using the protein of the invention or part thereof as a marker for specific cell compartments (especially the nucleus) and/or tissue types (especially fetal brain). For example, the protein of the invention or part thereof may be used to generate specific antibodies which would in turn allow the visualization of nuclear structures by methods well-known to those of skill in the art. In a similar fashion, antibodies raised against the protein of the invention may be used to identify particular developmental stages (fetal for instance) and/or given tissue types (brain for instance), as the protein of the invention is specifically expressed in brain tissues at a fetal stage. Antibodies and antiserum can also be used to inhibit undesirable carboxypeptidase activities in in vitro experiments and cell cultures, as well as in biological samples and in vivo. Alternatively, quantitative analysis or detection of the protein of the invention, or of nucleic acids encoding the protein, can be carried out by any other technique known to those skilled in the art.

In another embodiment, the protein of the invention may be used to target heterologous compounds (polypeptides or polynucleotides) to the developing brain and/or the cell nucleus. For instance, a chimeric protein composed of the protein of the invention recombinantly or chemically fused to a protein or polynucleotide of therapeutic interest would allow the delivery of the therapeutic protein/polynucleotide specifically to the above-mentioned cellular/tissue targets (nucleus, fetal brain).

In another embodiment, the present invention relates to methods and compositions using the protein of the invention or a fragment thereof to hydrolyze one or several substrates, alone or in combination with other substances. The ability of the present protein to hydrolyze any particular substrate can easily be determined by carrying out a hydrolysis reaction using standard assay techniques such as the ones decribed by Slusher et al. (Slusher et al.—Prostate—2000, 44(1): 55–60) or any other technique well known to those skilled in the art. Potential substrates are any substance containing a peptide bond, more specifically a C-terminal peptide bond. Such substances include, but are not limited to, polypeptides, folic acid and its analogues (e.g. methotrexate). For example, the protein of the invention or part thereof is added to a sample containing the substrate(s) in conditions allowing hydrolysis, and allowed to catalyze the hydrolysis of the substrate(s). Hydrolyzed substrates are then detected using standard methods known to those skilled in the art.

In a preferred embodiment, the protein of the invention or part thereof may be used to modulate cellular transcriptional activity, thereby modulating cellular differentiation. Specifically, as nuclear carboxypeptidases play a role in inhibiting transcription associated with differentiation, then an increase in the activity or expression of the protein can be used to inhibit differentiation. The ability to inhibit differentiation has a number of uses, for example during the cultivation of undifferentiated pluripotent cells to maintain the cultured cells in an undifferentiated state until the need for a given cell type arises (in cases of grafts for instance). The level of the protein activity or expression can be increased in any of a number of ways, including by introducing a polynucleotide encoding the protein into cells, by administering the protein itself to cells, or by administering to cells a compound that increases protein activity or expression. Alternatively, the protein of the invention can be inhibited, thereby enhancing cellular differentiation. The ability to promote differentiation has many uses, including in the treatment or prevention of cancer, as cancer cells are often in a relatively undifferentiated state, and cellular differentiation typically accompanies by growth arrest.

In another embodiment, the protein of the invention or part thereof may be used to diagnose, treat and/or prevent disorders where the presence of substrates, for example excess proteins or peptides, is undesirable or deleterious. Such disorders include but are not limited to, cancer, neurodegenerative disorders such as Parkinson's and Alzheimer's diseases, and diabetes. In another embodiment, the protein of the invention or part thereof may be used to identify or quantify the amount of a given substrate (e.g. a peptide, folic acid, or methotrexate) in a biological sample. In a preferred embodiment, the protein of the invention or part thereof is used in assays and diagnostic kits for the identification and quantification of substrates in a biological sample.

In a most preferred embodiment, the protein of the invention or part thereof can be used in cancer chemotherapies in rescue therapy following toxic high dose methotrexate regimes. Many carboxypeptidases can cleave the C-terminal glutamate moiety from folic acid and its analogues, such as methotrexate. The key role of reduced folates as coenzymes in many biological pathways including those leading to DNA synthesis via the pyrimidines and purines, has made folic acid a target molecule for chemotherapy. Tumor cells grow rapidly and have a high rate of nucleic acid synthesis. Depletion of folic acid has cytotoxic effects, primarily in replicating tissues, and can inhibit growth of tumors with high folic acid requirements. Many carboxypeptidases can directly deplete folate by hydrolytic removal of its glutamate moiety. In cancer chemotherapy, methotrexate (4-amino-$N^{10}$-methyl-pteroyl-glutamate) is commonly used to deplete the pool of reduced folates by inhibiting dihydrofolate reductase (DHFR), which catalyses the reduction of folates into biologically active tetrahydrofolate form, essential in the biosynthesis of all folate coenzymes. Thus, the protein of the invention or part thereof could be used in rescue therapy following toxic high-dose regimes such as described by Widemann et al. (Widemann B. et al.—Proc. Am. Assoc. Cancer Res.—1995, 36, p232)

and Chabner et al. (Chabner B. et al.—Nature—1972, 239, p395–397), which disclosures are hereby incorporated by reference in their entity. The basis of this strategy is that hydrolysis of methotrexate produces 4-amino-$N^{10}$-methyl-pteroate that is about 100 times less active as an inhibitor of DHFR.

In another preferred embodiment, the protein of the invention or part thereof can be used in an enzyme/prodrug strategy to treat a number of pathologies, especially those treated with drugs associated with severe side effects, including, but not limited to, autoimmune diseases and chronic inflammatory diseases such as rheumatoid arthritis, and cancer chemotherapy. These side effects can be mainly explained by the fact that the in vivo selectivity of the drugs used is too low (for example, the inadequate selectivity between tumor and normal cells of most anticancer drugs is well known and their toxicity to normal tissues is dose limiting). In the first phase of one example of such a protocol, a conjugate of the protein of the invention or part thereof and an antibody to a tissue specific antigen (for example, tumor specific antigens in the case of cancer chemotherapy) is administered. After a delay to allow residual enzyme conjugate to be cleared from the blood, a relatively non-toxic compound is administered to the patient. This non-toxic compound is a substrate of the protein of the invention, and is converted by the protein into a substantially more toxic compound. Thus, because of the previous, targeted administration of the protein of the invention, when the non-toxic compound is administered, the toxic compound is only produced in the vicinity of the cells targeted by the fusion protein. This two-phase approach has been termed antibody-directed enzyme-prodrug therapy (ADEPT); this approach is reviewed by Melton et al. (Melton R. et al.—J. Natl. Cancer Inst.—1996, 88, p153–165). Alternatively the first phase can be replaced by a gene therapy approach resulting in the de novo synthesis of the protein of the invention or part thereof by cells from the targeted tissue, this has been termed gene-dependent enzyme/prodrug therapy (GDEPT). Another advantage of these 2 approaches (ADEPT and GDEPT) is that a single enzyme molecule is capable of activating many prodrug molecules.

Protein of Seq Id No: 242 (Internal Designation 119-003-4-0-C2-CS)

The protein of SEQ ID NO: 242, encoded by the cDNA of SEQ ID No: 1, is homologous to proteins of the M20 metallopeptidases family (EC 3.4.17.X). The protein of the invention is over-expressed in the spinal cord and the brain.

The M20 metallopeptidase family of proteins are all peptidases (i.e. enzymes able to hydrolyze peptide bonds) furthermore they are all exopeptidases, which means that they can hydrolyze the terminal amino acid of a protein or peptide. Members of the M20 peptidase family are glutamate carboxypeptidases, which are capable of releasing the C-terminal glutamate residue, by hydrolysis, from a wide range of N-acyl groups, including peptidyl, aminoacyl, benzoyl, benzyloxycarbonyl, folyl, and pteroyl groups, and physiologically are involved in the catabolism of proteins. M20 carboxypeptidases are either monomeric or homodimeric (i.e. 2 identical proteins assembled to from the enzyme). In order to be active, metallopeptidases must be associated with a metallic cofactor (either Zinc or Cobalt depending on the enzyme). The most studied carboxypeptidase of the M20 family is carboxypeptidase G2 (CPG2) (EC 3.4.17.11), a bacterial enzyme from *Pseudomonas* sp. (strain RS-16). CPG2 is a dimeric Zinc carboxypeptidase that cleaves the C-terminal glutamate moiety from a number of molecules.

The protein of SEQ ID No: 242 includes the pfam signature for M20 peptidase (position 107 to 451). The protein of SEQ ID No: 242 also includes a number of amino acids that are conserved throughout the M20 protease family especially those that interact with the metal cofactor. Preferred polypeptides of the invention are polypeptides of SEQ ID No: 242 that include the highly conserved amino acids: 133, 135, 149, 163, 200, 201 and/or 262, which are present in over 80% of the members of the M20 peptidase family, and/or amino acids 139, 157, 162, 16, 367 and/or 377, which are present in over 60% of the members of the M20 peptidase family. Of particular interest are amino acids 133, 166, 201 and 262, which by homology are probably involved in the interaction with the metal cofactors. Thus it is believed that the protein of SEQ ID No: 242 or part thereof is a peptidase, preferably a carboxypeptidase, more preferably a metallocarboxypeptidase of the M20 family. Other preferred polypeptides of the invention are any fragments of SEQ ID No: 242 having any of the biological activities described herein.

Determination of carboxypeptidase activity on specific substrates can easily be obtained by carrying out the hydrolysis using standard assay techniques such as the ones decribed by Slusher et al. (Slusher et al.—Prostate—2000, 44(1): 55–60) or any other technique well known to those skilled in the art. Potential substrates are any substance containing a peptide bond, more especially C-terminal peptide bonds, and even more specifically, C-terminal glutamate. Such substances include but are not limited to peptides, folic acid and its analogues (e.g. methotrexate).

In an embodiment the protein of the invention or part thereof could be used to develop assay tools to identify brain and spinal cord tissue since the protein of the invention is overexpressed in these tissues.

In still another embodiment, the protein of the invention or part thereof may be used to diagnose, treat and/or prevent disorders where the presence of substrates, for example excess proteins, is undesirable or deleterious. Such disorders include but are not limited to, cancer, neurodegenerative disorders such as Parkinson's and Alzheimer's diseases, and diabetes. In a most preferred embodiment, the protein of the invention or part thereof can be used in cancer chemotherapies in rescue therapy following toxic high dose methotrexate regimes. Enzymes of the M20 peptidase family can cleave the C-terminal glutamate moiety from folic acid and its analogues, such as methotrexate. The key role of reduced folates as coenzymes in many biological pathways including those leading to DNA synthesis via the pyrimidines and purines, has made folic acid a target molecule for chemotherapy. Tumor cells grow rapidly and have a high rate of nucleic acid synthesis. Depletion of folic acid has cytotoxic effects, primarily in replicating tissues, and can inhibit growth of tumors with high folic acid requirements. Enzymes of the M20 peptidase family can directly deplete folate by hydrolytic removal of its glutamate moiety. In cancer chemotherapy, methotrexate (4-amino-$N^{10}$-methyl-pteroyl-glutamate) is commonly used to deplete the pool of reduced folates by inhibiting dihydrofolate reductase (DHFR), which catalyses the reduction of folates into biologically active tetrahydrofolate form, essential in the biosynthesis of all folate coenzymes. Thus the protein of the invention or part thereof could be used in rescue therapy following toxic high-dose regimes such as described by Widemann et al. (Widemann B. et al.—Proc. Am. Assoc. Cancer Res.—1995, 36, p232) and Chabner et al. (Chabner B. et al.—Nature—1972, 239, p395–397), which disclosures are hereby incorporated by reference in their entity. The basis of this strategy is that hydrolysis of methotrexate produces 4-amino-$N^{10}$-methyl-pteroate that is about 100 times less active as an inhibitor of DHFR.

In another preferred embodiment, the protein of the invention or part thereof can be used in an enzyme/prodrug strategy to treat a number of pathologies, especially those treated with drugs associated with severe side effects, including, but not limited to, autoimmune diseases and chronic inflammatory diseases such as rheumatoid arthritis, and cancer chemotherapy. These side effects can be mainly explained by the fact that the in vivo selectivity of the drugs used is too low (for example, the inadequate selectivity between tumor and normal cells of most anticancer drugs is well known and their toxicity to normal tissues is dose limiting). In the first phase of one example of such a protocol, a conjugate of the protein of the invention or part thereof and an antibody to a tissue specific antigen (for example, tumor specific antigens in the case of cancer chemotherapy) is administered. After a delay to allow residual enzyme conjugate to be cleared from the blood, a relatively non-toxic compound is administered to the patient. This non-toxic compound is a substrate of the protein of the invention, and is converted by the protein into a substantially more toxic compound. Thus, because of the previous, targeted administration of the protein of the invention, when the non-toxic compound is administered, the toxic compound is only produced in the vicinity of the cells targeted by the fusion protein. This two-phase approach has been termed antibody-directed enzyme-prodrug therapy (ADEPT), this approach is reviewed by Melton et al. (Melton R. et al.—J. Natl. Cancer Inst.—1996, 88, p153–165). Alternatively the first phase can be replaced by a gene therapy approach resulting in the de novo synthesis of the protein of the invention or part thereof by cells from the targeted tissue, this has been termed gene-dependent enzyme/prodrug therapy (GDEPT). Another advantage of these 2 approaches (ADEPT and GDEPT) is that a single enzyme molecule is capable of activating many prodrug molecules.

Protein of SEQ ID NO: 401 (Internal Designation 160-88-3-0-A8-CS.corr)

The protein of SEQ ID NO:401 encoded by the cDNA SEQ ID NO:160 is a splicing variant of the hypothetical human palmitoyl-protein thioesterase-2 (PPT2) (E.C. 3.1.2.22) (Genbank accession number AF020543), which is well conserved among eukaryotes (C. elegans and rodents) and exhibits homology with the palmitoyl protein thioesterase-1 (PPT1) (Genbank accession number L42809). The product of the cDNA SEQ ID NO: 160 is shorter than the human PPT2 (280 versus 308 amino acids respectively) with a gap located between the positions 174 and 203 of the protein PPT2. The protein of SEQ ID NO:401 has a variant, the protein of SEQ ID NO:402 encoded by the cDNA of SEQ ID NO: 161, thought to have the same functions and utilities.

PPT1 (E.C. 3.1.2.22) is a well-described protein, widely conserved among the murine, rat, bovine and human species (Swissprot accession number P50897). It is a lysosomal enzyme that functions in the removal of fatty acids from modified cysteine residues in proteins undergoing degradation (Hofmann S. L. et al, Neuropediatrics, 28: 27–30 (1997)). For example, PPT1 catalyses the deacylation H-ras and the alpha subunits of heterodimeric G proteins in vitro (Camp L. A., J. Biol. Chem., 268: 22566–22574 (1993) and 269: 23212–23219 (1994)). Deacylation by PPT1 may be a prerequisite for complete digestion of the modified polypeptides. In fact there is evidence that palmitoylation leads to increased protection against proteolytic digestion. Both the salivary mucus glycoprotein (Slomiany B. L., Biochem. Biophys. Res. Commun., 151: 1046–1053 (1988),) and chemically acylated bee venom phospholipase A2 (Diaz, R. E., Biochem. Biophys. Acta, 830: 52–58 (1985)) are more resistant to treatment with proteinases than their deacylated forms. Mutations in PPT1 enzyme were shown to underlie the hereditary neurodegenerative disorder, infantile neuronal ceroid lipofuscinosis (Vesa et al., Nature, 376: 584–587 (1995)).

Recently, Soyombo and Hofmann (J.Biol.Chem, 272: 27456–27463, (1997)) described a second lysosomal thioesterase, PPT2, that shares 20% identity with PPT1. The PPT2 enzyme presumably also plays a role in lysosomal thioester catabolism but has a substrate specificity distinct from that of PPT1. While little is known about the substrate specificity of PPT2, the enzyme is highly active against palmitoylated model substrates such as palmitoyl CoA. PPT2 did not hydrolyse the acyl-cysteine bond of the protein substrates routinely used to assay PPT1 such as H-Ras and albumin. This finding suggest that although both enzymes possess intrinsic palmitoyl thioesterase activity, the "leaving group" recognized by the enzymes may differ. One possibility is that PPT2 recognizes palmitoylated protein substrates but that these substrates differ from those recognized by PPT1. A second possibility is that PPT2 recognizes a novel lipid thioester substrate that is not derived from acylated proteins. Aguado et al. (Biochem J., 341:679–689, (1999)) demonstrated that PPT2 is an acyl thioesterase. However they cannot distinguish between esterase (thioesterase) and lipase activity. PPT2 shows very high S-thioesterase activity towards the acyl chains $C_{14:0}>_{16:0}$, moderate activity towards the acyl chains $C_{14:1}>C_{20:4}\approx C_{16:1}\approx C_{18:0}\approx C_{12:0}>C_{18:2}\approx C_{18:3}>C_{22:1}\approx C_{18:1}\approx C_{20:0}$, low activity towards the acyl chains $C_{10:0}$ and $C_{22:0}$, and no activity towards the acyl chain $C_{24:0}$, $C_{8:0}$, $C_{6:0}$, $C_{4:0}$, and $C_{2:0}$. PPT2 has a broader range of action than PPT1, although both have a preference for long acyl chains (more than 12 or 14 carbons) over shorter acyl chains (less than 12 carbons). Aguado et al. (supra) also presented a detailed characterization of PPT2 gene product. The putative 302-residue PPT2 and the protein of the invention contains a hydrophobic leader peptide at the N-terminus (signal peptide with a cleavage site predicted at position 34 of the protein of the invention) suggesting that they are secretory glycoproteins. Both proteins exhibit two motifs located at the N-terminus from positions 108 to 121. One motif is common to triglycerides lipases (from position 110 to 121) and the other one to eukaryotic thiol (Cys) proteases (from positions 108 to 121). Triglyceride lipases are lipolytic enzymes that hydrolyse the ester bond of triglycerides. The most conserved region in all these proteins is centered on a serine residue located in a conserved Gly-Xaa-Ser-Xaa-Gly motif. The PPT2 protein and the protein of the invention contain a cysteine residue (position 115) instead of the first glycine residue in the motif but other lipases with one mismatch in either of the consensus have been described (Blow D., Nature, 343: 694–695 (1990)). In the same region as the lipase motif, PPT2 and the protein of the invention contains a motif common to the active site of eukaryotic thiol (Cys) protease but with a leucine residue (position 113) instead of the glycine at the position 5 of the pattern. In addition, the amino acid sequence of the putative PPT2 shows, at the C-terminus, from positions 171 to 186, a motif common to growth factor and cytokine receptors family, which is not present in the protein of the invention.

Aguado et al. (supra) have found that PPT2 is expressed in cells of the immune system as an approximatively 42 kDa protein in cells extracts and supernatants and is transcribed as at least five different transcripts. The PPT2 gene is located in the class III region of the human MHC which contains several genes encoding proteins with potential roles in the immune system and in inflammation. In addition, Aguado et al. (supra) showed that very large amounts of PPT2 are secreted. However this is not in disagreement with an intracellular activity because the secreted protein could be internalized into the cell through a receptor and act on target located in an intracellular organelle. This mechanism has been described for the secreted PPT1, which can be internalized into the cell by mannose-6-phosphate receptor to act in the lysosome (Verkruyse and Hofmann, *J.Biol.Chem.*, 271: 15831–15836, (1996)), and Soyombo and Hofmann (*J.Biol.Chem*, 272: 27456–27463, (1997)) reported that PPT2 binds to mannose-6 phosphate receptor.

Palmitoylation refers to posttranslational modification of proteins in which the most common fatty acids of the cell (i.e. palmitic, stearic and oleic acids) are attached to the side chain of cysteine residues via high-energy thioester linkages (Bizzozero, O. A. et al, *Neurochem.Res.*, 19: 923–933 (1994); Casey P. J., *Science*, 268: 221–225 (1995)). At present a large number of proteins of diverse origin, structure and function are known to be modified with these fatty acids that attach them to inner surface of the plasma membrane, where the can function optimally (Casey P. J., *Science*, 268: 221–225 (1995)). Being anchored to membranes is a process necessary for the diverse cellular functions of these modified proteins, including signal transduction, vesicle transport and maintenance of the cytoarchitecture. Almost every tissue and subcellular organelle contains characteristic set of palmitoylated proteins.

The protein of the invention is overexpressed in brain. In recent years a considerable number of functionally relevant nervous system proteins including ions channels, neurotransmitter receptors, signal transduction components and cell-adhesion molecules have been found to be palmitoylated. Although the nervous system is not an exception to this rule, both the number of modified protein in this tissue and the dynamic nature of protein palmitoylation suggest that this modification is critical for regulating important biological processes and that the addition or removal of the fatty acid serves to regulate the activity of these proteins rather that to define their function.

It is believed that the protein of SEQ ID NO:401 or part thereof is an hydrolase, preferably acting on ester bonds, more preferably a thiolester hydrolase, even more preferably an acyl-thioesterase which, as such, plays a role in fatty acid metabolism, in cellular vesicle transport and maintenance of the cytoarchitecture, in cellular proteolysis, endocytosis, signal transduction, lysosomal storage, cell proliferation and differentiation, immune and inflammatory response. The enzyme's substrates are compounds preferably containing an ester bond, preferably a thiol ester bond, more preferably an acyl thioester bond. Preferred polypeptides of the invention are polypeptides comprising the amino acids of SEQ ID NO:401 from positions 108 to 121, and 110 to 121. Other preferred polypeptides of the invention are fragments of SEQ ID NO:401 having any of the biological activities described herein. The hydrolytic activity of the protein of the invention or part thereof may be assayed using any of the assays known to those skilled in the art including those described in Smith et al., *Biochem.J*, 212: 155 (1983), Spencer et al., *J.Biol.Chem.*, 253: 5922 (1978) and Aguado et al. (supra) or in U.S. Pat. No. 5,445,942.

In another preferred embodiment, the protein of the invention or part thereof may be used to diagnose, treat and/or prevent disorders where the presence of substrates is undesirable or deleterious. Such disorders include but are not limited to infantile neuronal ceroid lipofuscinosis and lysosomal diseases. For diagnostic purposes, the expression of the protein of the invention could be investigated using any of the Northern blotting, RT-PCR or immunoblotting methods described herein and compared to the expression in control individuals. For prevention and/or treatment purposes, the Ail expression of protein of the invention may be enhanced using any of the gene therapy methods described herein or known to those skilled in the art.

In addition, the protein of the invention or part thereof may be used to identify inhibitors for mechanistic and clinical applications. Such inhibitors may then be used to identify or quantify the protein of the invention in a sample, and to diagnose, treat or prevent any of the disorders where the protein's hydrolytic activity is undesirable and/or deleterious including but not limited to lysosomal diseases, neurodegenerative disorder such as infantile neuronal ceroid lipofuscinosis, Parkinson's and Alzheimer's diseases, inflammatory and immune disorders including allergies and leukemia.

Another object of the present invention are compositions and methods of targeting heterologous compounds, either polypeptides or polynucleotides to lysosomes by recombinantly or chemically fusing a fragment of the protein of the invention to an heterologous polypeptide or polynucleotide. Preferred fragments are any fragments of the protein of the invention, or part thereof, that may contain targeting signals for lysosomes such as those described in Vitale et al, Mol.Cell.Biol, 20: 7342–52 (2000), Blagoveshchenskaya et al., J.Biol.Chem., 273: 2729–37 (1998) and Kornfeld, FASEB J., 1: 462–8 (1987)). Such heterologous compounds may be used to modulate lysosomal activity. For example, they may be used to induce and/or prevent a lysosomal protein degradation. Moreover, antibodies binding to the protein of the invention or part thereof may be used for detection of the lysosomes using any techniques known to those skilled in the art.

In still another embodiment, the invention relates to methods and compositions using the protein of the invention or part thereof as a marker protein to selectively identify tissues, preferably brain tissues. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

Another embodiment of the present invention relates to methods and compositions using the protein of the invention or part thereof to modify plant lipid composition using any assay known to those skilled in the art including those described by the U.S. Pat. Nos. 5,955,650, 5,945,585 and 5,807,893. Indeed, plant lipids have a variety of nutritional uses and many recent research efforts have examined the role that saturated and unsaturated fatty acids play in reducing the risk of coronary heart disease. In the past, it was believed that mono-unsaturates, in contrast to saturates and poly-unsaturates, had no effect on serum cholesterol and coronary heart disease risk. Several recent human clinical studies suggest that diets high in mono-unsaturated fat and low in saturated fat may reduce the "bad" (low-density lipoprotein) cholesterol while maintaining the "good" (high-density lipoprotein) cholesterol (Mattson et al, *Journal of Lipid Research*, 26: 194–202 (1985)).

In still another embodiment, the protein of the invention or part thereof may be used in enzyme replacement therapy, due to the ability of cells to take up exogeneously supplied protein and target it to lysosomes (Neufeld E. F., *Annu.Rev.Biochem.* 60: 257–280(1991), Brady R. O. et al, *J.Inher.Metab.Dis.* 17: 510–519 (1994)), or in bone-marrow transplantation (Hoogerbrugge P. M. et al, *Lancet*, 345: 1398–1402 (1995)), as bone-marrow-derived microglial cells are believed to penetrate the blood-brain barrier and may theoretically be able to provide sufficient enzyme to correct the metabolic defect in neurons (Krivit W., *Cell transplant.*, 4: 385–392 (1995)). The protein of the invention or part thereof may be also used in genetic engineering of transplanted cells (Salvetti A. et al, *Br.Med.J.* 51: 106–122 (1995)) or neural progenitor cell engraftment (Snyder E. Y., *Nature*, 374: 367–370 (1995)) using any technique known to those skilled in the art.

Protein of SEQ ID NO: 254 (Internal Designation 106-006-1-0-E3-CS)

Angiogenin is a member of the pancreatic Rnase superfamily of proteins. Its mechanism of action is postulated to involve multiple interactions with other proteins through specific regions on the molecular surface of angiogenin. Potential partners of angiogenin include heparin, plasminogen, elastase, angiostatin, actin, and a 170 kDa receptor on the surface of endothelial cells [Strydom, D. J. (1998) Cell. Mol. Life Sci. 54, 811–824].

Angiogen is required for the process of angiogenesis. Tumor growth requires angiogenesis, and several antiangiogenic agents have been produced and are currently in the clinical trial stage. It has also been shown that recurrent gastric cancer patients had a much higher serum concentration of angiogenin than primary gastric cancer patients [Shimoyama, S. and Kaminishi, M. (2000) J. Cancer Res. Clin. Oncol 126, 468–474]. Therefore, angiogenin can be used as a diagnostic marker for the evaluation of cancer aggressiveness or as an early marker for recurrence over a follow-up period.

Angiogenic is a potent inducer of angiogenesis [Fett, J. W.; Strydom, D. J.; Lobb, R. R.; Alderman, E. M.; Bethune, J. L.; Riordan, J. F.; and Vallee, B. L. (1985) Biochemistry 24, 5480–5486]. Angiogenesis is a complex process of blood vessel formation comprising of several separate but interconnected steps at the cellular and biochemical level including: (i) activation of endothelial cells by the action of an c stimulus, (ii) adhesion and invasion of activated endothelial cells into the surrounding tissues and migration toward the source of the angiogenic stimulus, and (iii) proliferation and differentiation of endothelial cells to form a new microvasculature [Folkman, J. and Shing, Y. (1992) J. Biol. Chem. 267, 10931–10934; Moscatelli, D. and Rifkin, D. B. (1988) Biochim. Biophys. Acta 948, 67–85].

Angiogenin has been demostrated to induce most of the individual events in the process of angiogenesis including binding to endothelial cells [Badet, J.; Soncin F.; Guitton, J. D.; Lamare, O.; Cartwright, T.; and Barritault, D. (1989) Proc. Natl. Acid Sci U.S.A. 86, 8427–8431], stimulating second messengers [Bicknell, R. and Vallee, B. L. (1988) Proc. Natl. Acad Sci. U.S.A. 85, 5961–5965], mediating cell adhesion [Soncin, F. (1992) Proc. Natl. Acad. Sci. U.S.A. 89, 2232–22361], activating cell-associated proteases [Hu, G. F. and Riordan, J. F. (1993) Biochem. Biophys. Res. Commun. 197, 682–687], inducing cell invasion [Hu, G-F.; Riordan, J. F.; and Vallee, B. L. (1994) Proc. Natl. Acad. Sci. U.S.A. 91, 12096–12100], inducing proliferation of endothelial cells [Hu, G-F.; Riordan, J. F.; and Vallee, B. L. (1997) Proc. Natl. Acad. Sci. U.S.A. 94, 2204–2209] and organizing the formation of tubular structures from the cultured endothelial cells [Jimi, S-I.; Ito, K-I.; Kohno, K.; Ono, M.; Kuwano, M.; Itagaki, Y.; and Isikawa, H. (1985) Biochem. Biophys. Res. Commun. 211, 476–483]. Angiogenin has also been shown to undergo nuclear translocation in endothelial cells via receptor-mediated endocytosis [Moroianu, J. and Riordan, J. F. (1994) Proc. Natl. Acad. Sci. U.S.A. 91, 1677–1681] and nuclear localization sequence-assisted nuclear import [Moroianu, J. and Riordan, J. F. (1994) Biochem. Biophys. Res. Commun. 203, 1765–1772].

While angiogenesis is a tight-controlled process under usual physiological conditions, abnormal angiogenesis can have devastating consequences in pathological conditions such as arthritis, diabetic retinopathy and tumor growth. It is now well-established that the growth of virtually all solid tumors is angiogenesis dependent [Folkman, J. (1989) J. Natl. Cancer Inst. 82, 4–6]. Angiogenesis is also a prerequisite for the development of metastasis, since it provides the means whereby tumor cells disseminate from the original primary tumor and establish at distant sites [Mahadevan, V. and Hart, I. R. (1990) Rev. Oncol. 3, 97–103; Blood, C. H. and Zetter B. R. (1990) Biochim. Biophys. Acta 1032, 89–118]. Therefore, interference with the process of tumor-induced angiogenesis can be an effective therapy for both primary and metastatic cancers.

Although originally isolated from medium conditioned by human colon cancer cells (Fett et al. (1985), supra), and subsequently shown to be produced by several other histological types of human tumors [Rybak, S. M.; Fett, J. W.; Yao, Q-Z.; and Vallee, B. L. (1987) Biochem. Biophys. Res, Commun. 146, 1240–1248; Olson, K. A.; Fett, J. W.; French, T. C.; Key, M. E.; and Vallee, B. L. (1995) Proc. Natl. Acad. Sci. U.S.A. 92, 442–446], angiogenin also is a constituent of human plasma and normally circulates at a concentration of 250–360 ng/ml [Shimoyama, S.; Gansauge, F.; Gansauge, S.; Negri, G.; Oohara, T.; and Beger, H. G. (1996) Cancer Res. 56, 2703–2706; Blaser, J.; Triebl, S.; Kopp, C.; and Tschesche, H. (1993) Eur. J. Clin. Chem. Clin. Biochem. 31, 513–516].

Several inhibitors of the functions of angiogenin have been developed. These include: (i) monoclonal antibodies (mAbs) [Fett, J. W.; Olson, K. A.; and Rybak, S. M. (1994) Biochemistry 33, 5421–5427], (ii) an angiogenin-binding protein [Hu, G-F.; Chang, S-I.; Riordan, J. F.; and Vallee, B. L. (1991) Proc. Natl. Acad. Sci. U.S.A. 88, 2227–2231; Hu, G-F.; Strydom, D. J.; Fett, J. W.; Riordan, J. F.; and Vallee, B. L. (1993) Proc. Natl. Acad. Sci. U.S.A. 90, 1217–1221; Moroianu, J.; Fett, J. W.; Riordan, J. F.; and Vallee, B. L. (1993) Proc. Natl. Acad. Sci. U.S.A. 90, 3815–3819], (iii) the placental ribonuclease inhibitor (PRI) [Shapiro, R and Vallee, B. L. (1987) Proc. Natl. Acad. Sci. U.S.A. 84, 2238–2241], (iv) peptides synthesized based on the C-terminal sequence of angiogenin [Rybak, S. M.; Auld, D. S.; St. Clair, D. K.; Yao, Q-Z.; and Fett, J. W. (1989) Biochem. Biophys. Res. Commun. 162, 535–543], and (v) inhibitory site-directed mutagenesis of angiogenin [Shapiro, R. and Vallee, B. L. (1989) Biochemistry 28, 7401–7408].

The subject invention provides for an angiogenin variant protein/polypeptide of SEQ ID NO:254. The invention also provides biologically active fragments of SEQ ID NO:254 comprising the Thr amino acid residue of position 52 of SEQ ID NO:254. In one embodiment, the polypeptides of SEQ ID NO: 254 are interchanged with the corresponding polypeptides encoded by the human cDNA of clone 106-006-1-0-E3-CS. "Biologically active fragments" are defined as those peptide or polypeptide fragments having at least one of the biological functions of the full length protein (e.g., stimulation of angiogenesis). Compositions of the protein/polypeptide of SEQ ID NO:254, or biologically active fragments thereof, are also provided by the subject invention. These compositions may be made according to methods well known in the art. The polypeptides of the present invention can be used in methods described herein and known in the art for other forms of angiogenin.

The invention also provides variants of the protein of SEQ ID NO: 254. These variants have at least about 80%, more preferably at least about 90%, and most preferably at least about 95% amino acid sequence identity to the amino acid sequence encoded by SEQ ID NO: 254. Variants according to the subject invention also have at least one functional or structural characteristic of the protein of SEQ ID NO:254. The invention also provides biologically active fragments of the variant proteins. Compositions of variants, or biologically active fragments thereof, are also provided by the subject invention. These compositions may be made according to methods well known in the art. Unless otherwise indicated, the methods disclosed herein can be practiced utilizing the protein encoded by SEQ ID NO: 254, biologically active fragments of SEQ ID NO:254, variants of SEQ ID NO:254, and biologically active fragments of the variants.

Because of the redundancy of the genetic code, a variety of different DNA sequences can encode the amino acid sequence of SEQ ID NO:254. In a preferred embodiment, SEQ ID NO: 254 is encoded by clone 106-006-1-0-E3-CS or SEQ ID NO:13. It is well within the skill of a person trained in the art to create these alternative DNA sequences which encode proteins having the same, or essentially the same, amino acid sequence. These variant DNA sequences are, thus, within the scope of the subject invention. As used herein, reference to "essentially the same" sequence refers to sequences that have amino acid substitutions, deletions, additions, or insertions that do not materially affect biological activity. Fragments retaining one or more characteristic biological activity of the protein encoded by clone 106-006-1-0-E3-CS are also included in this definition. The nucleotides "C" and "G" of positions 338 and 339 of SEQ ID NO:13 represent polymorphisms and can be used in association studies and other methods in the art for sing markers.

"Recombinant nucleotide variants" are alternate polynucleotides which encode a particular protein. They can be synthesized, for example, by making use of the "redundancy" in the genetic code. Various codon substitutions, such as the silent changes which produce specific restriction sites or codon usage-specific mutations, can be introduced to optimize cloning into a plasmid or viral vector or expression in a particular prokaryotic or eukaryotic host system, respectively.

In one aspect of the subject invention, SEQ ID NO:254, and variants thereof, can be used to generate polyclonal or monoclonal antibodies. Both biologically active and immunogenic fragments of SEQ ID NO:254, or variant proteins, can be used to produce antibodies. Polyclonal and/or monoclonal antibodies can be made according to methods well known to the skilled artisan. Antibodies produced in accordance with the subject invention can be used in a variety of detection assays known to those skilled in the art. The antibodies may be used to agonize or antagonize the biological activity of the protein of SEQ ID NO:254.

SEQ ID NO:254 can be used as a marker for individuals at risk for the development or recurrence of tumors. As indicated supra, angiogenin is found at certain levels in normal individuals, normally at concentrations of 250–360 ng/ml. Thus, quantitative immunoassays can be used for the detection of abnormal levels (increased) of SEQ ID NO:254, thereby identifying those individuals at risk for the development of tumors. Alternatively, the subject invention provides antibodies specific for SEQ ID NO:254, or fragments thereof, which are used in routine immunoassays to screen for the presence or absence of SEQ ID NO:254, or fragments thereof.

Alternatively, the nucleic acids which encode SEQ ID NO: 254, or fragments thereof, may be used in hybridization assays to detect and/or quantitate the expression of SEQ ID NO: 254. Such hybridization assays are well known to the skilled artisan and can be practiced on a variety of samples, including, but not limited to, tumor cells, biopsied tissues, or normal tissue.

Molecules (see Strydom, D. J., (1998) Cell. Mol. Life Sci. 54, 811–824) that functionally inhibit the action of angiogenin can be used to treat patients with tumors. Because angiogenin is required for the vascularization of tumors, molecules which inhibit the biological activity of angiogenin can be used to reduce tumor vascularization and control tumor growth. Thus, another aspect of the invention provides molecules which inhibit, or reduce, the biological activity of SEQ ID NO: 254. One embodiment provides neutralizing antibodies to inhibit the biological activity of SEQ ID NO: 254. These neutralizing antibodies may be chimeric or humanized, according to methods well known in the art, to minimize the immunogenicity of the molecules when used in patients. Neutralizing antibodies may be used in conjunction with other known therapeutic modalities for the treatment of tumors.

Another embodiment of the invention utilizes the concept that expression of specific genes can be suppressed by oligonucleotides having a nucleotide sequence complementary to the mRNA transcript of the target gene. This suppression occurs by selectively impeding translation and has been termed an "antisense" methodology. In addition, "antigene" or "triplex" methodologies may also suppress expression of genes by using an oligonucleotide which is complementary to a selected site of double stranded DNA, thereby forming a triple-stranded complex to selectively inhibit transcription of the gene. Both "antisense" and "antigene" methodologies can be used to inhibit or reduce the expression of the gene of SEQ ID NO: 254, and thereby provide therapeutic benefit to the patient being treated. Methods of treating individuals using antigene and antisense methodologies are well known to those skilled in the art (see, for example, "Antisense Therapeutics" Agrawal, S. (ed), Humana Press, 1996; Crooke, S. T., and Bennett, C. F. (1996) Annu. Rev. Pharmacol. Toxicol. 36, 107–129; "Prospects for the Therapeutic Use of Antigene Oligonucleotides", Maher, L. J. (1996) Cancer Investigation 14(1), 66–82 each hereby incorporated by reference in its entirety).

As additional examples, U.S. Pat. No. 5,098,890 is directed to antisense oligonucleotides complementary to the c-myb oncogene and antisense oligonucleotide therapies for certain cancerous conditions. U.S. Pat. No. 5,135,917 provides antisense oligonucleotides that inhibit human interleukin-1 receptor expression. U.S. Pat. No. 5,087,617 provides methods for treating cancer patients with antisense oligonucleotides. U.S. Pat. No. 5,166,195 provides oligonucleotide inhibitors of HIV. U.S. Pat. No. 5,004,810 provides oligomers capable of hybridizing to herpes simplex virus Vmw65 mRNA and inhibiting replication. U.S. Pat. No. 5,194,428 provides antisense oligonucleotides having antiviral activity against influenza virus. U.S. Pat. No. 4,806,463 provides antisense oligonucleotides and methods using them to inhibit HTLV-III replication. U.S. Pat. No. 5,286,717 is directed to a mixed linkage oligonucleotide phosphorothioates complementary to an oncogene. U.S. Pat. Nos. 5,276,019 and 5,264,423 are directed to phosphorothioate oligonucleotide analogs used to prevent replication of foreign nucleic acids in cells. Each of these patents is hereby incorporated by reference in its entirety.

The subject invention also provides modified/derivatized nucleic acids encoding SEQ ID NO: 254. These include those modifications which increase the stability and/or affinity of these compounds for targets. Phosphorothioate analogs of oligodeoxynucleotides (ODNs), in which nonbridging phosphoryl oxygens in the backbone of DNA are substituted with sulfur ([S]ODNs) are substantially more stable than their native phosphodiester counterparts. Other derivatives, such as those alkylated on sugar oxygen groups, show enhanced target affinity. [S]ODNs possess good biological activity, pharmacology, pharmacokinetics and safety in vivo (Agrawal (1996), supra). Successful inhibition of specific gene function has been achieved by targeting various sites on specific mRNA sequences that include the AUG translational initiation codon, 5'-transcriptional start site, 3'-termination codon and sequences in both the 5' and 3'-untranslated regions. These derivatized nucleic acids can be used in any of the aforementioned methodologies.

Protein of SEQ ID: 387 (Internal Designation 105-073-2-0-A 7-CS)

The protein of SEQ ID NO:387 encoded by the cDNA of SEQ ID NO:146 is expressed in liver, ovary, prostate and overexpressed in salivary glands. The protein of SEQ ID NO:387 belongs to the abhydrolase family, and is caracterized by the alpha/beta hydrolase fold (Protein Eng 1992;5: 197–211, which disclosure is hereby incorporated by reference in its entirety), that is common to a number of hydrolytic enzymes of widely differing phylogenetic origin and catalytic function.

The core of each enzyme is an alpha/beta-sheet (rather than a barrel), containing 8 strand connected by helices. The enzymes are believed to have diverged from a common ancestor, preserving the arrangement of the catalytic residues. All have a catalytic triad, the elements of which are borne on loops, which are the best conserved structural features of the fold.

Epoxide hydrolases are a family of enzymes which hydrolyze a variety of exogenous and endogenous epoxides to their corresponding diols. The epoxide hydrolase add water to epoxides, forming the corresponding diol. On the basis of sequence similarity, it has been proposed that the mammalian soluble epoxide hydrolase contain 2 evolutionarily distinct domains, the N-terminal domain is similar to bacterial haloacid dehalogenase, while the C-terminal domain is similar to soluble plant epoxyde hydrolase, microsomal epoxide hydrolase, and bacterial haloalcane dehalogenase (DNA Cell Biol. 14:61–71 (1995), which disclosure is hereby incorporated by reference in its entirety. Human epoxide hydrolase catalyse the addition of water to epoxides to form the corresponding dihydrodiol. The enzymatic hydratation is essentially irreversible and produces mainly metabolites of lower reactivity that can be conjugated and excreted. The reaction of epoxide hydrolase is therefore generally regarded as detoxifying. Commonly the function of epoxide hydrolase is finally followed by excretion of the diols. However, reactivation of certain diols by a second epoxidation may happen. Epoxide hydrolase inactivates also the epoxides existing in the metabolism of endogenous compounds. Lipophilic xenobiotics tend to accumulate into tissues, and they must be transformed to water soluble compounds to enable the excretion. In this transformation process reactive intermediates are produced. If biotransformation fails to detoxify these reactive intermediates, they may react covalently with critical targets like the genetic material, or start harmful reaction chains like lipid peroxidation. Therefore, epoxide hydrolases are thought to be responsible for carcinogenicity and mutagenicity phenomenon (Exp Pathol 1990;39(3–4):195–6.). In addition, the interaction between epoxide hydrolase activity and alcohol-metabolizing enzymes, suggests that epoxide hydrolase activity may be associated with the susceptibility to alcoholic liver disease and hepatocellular carcinoma (Toxicol. Lett. 10;115 (1):17–22 (2000), which disclosure is hereby incorporated by reference in its entirety). Compounds containing the epoxide functionality have become common environmental contaminants because of their wide use as pesticides, sterilants, and industrial precursors. Such compounds also occur as products, by-products, or intermediates in normal metabolism and as the result of spontaneous oxidation of membrane lipids (i.e. see, Brash, et al., Proc. Natl. Acad. Sci., 85:3382–3386 (1988), and Sevanian, A., et al., Molecular Basis of Environmental Toxicology (Bhatnager, R. S., ed.) pp. 213–228, Ann Algor Science, Michigan (1980)). As three-membered cyclic ethers, epoxides are often very reactive and have been found to be cytotoxic, mutagenic and carcinogenic (i.e. see Sugiyama, S., et al., Life Sci. 40:225–231 (1987)). Cleavage of the ether bond in the presence of electrophiles often results in adduct formation. As a result, epoxides have been implicated as the proximate toxin or mutagen for a large number of xenobiotics. Reactions of detoxification using epoxide hydrolases typically decrease the hydrophobicity of a compound, resulting in a more polar and thereby excretable substance.

The protein of SEQ ID NO:387 or part thereof is EPOXYLASE-1, an epoxyde hydrolase. Preferred polypeptides of the invention are polypeptides comprising the amino acids of SEQ ID NO: 387 from positions 2 to 132, 52 to 137, 29 to 120, 12 to 137, 19 to 136, 151 to 209, 141 to 209, 30 to 108, and 35 to 108. Other preferred polypeptides of the invention are fragments of SEQ ID NO: 387 having any of the biological activity described herein. The hydrolytic activity of the protein of the invention or part thereof may be assayed using any of the assays known to those skilled in the art including those described in Cancer res 40(7):2552–6 (1980); Exp Pathol 39(3–4): 195–6 (1990), which disclosures are hereby incorporated by reference in their entireties.

The invention also relates to methods and compositions using an Epoxylase polypeptide of the invention or part thereof to diagnose, prevent and/or treat several disorders linked to overexpression of the protein of the invention including alcoholic liver disease, hepatocellular carcinoma, ovarian and prostate cancers.

In addition, the protein of the invention or part thereof may be used to identify inhibitors for mechanistic and clinical applications. Such inhibitors may then be used to identify or quantify the protein of the invention in a sample, and to diagnose, treat or prevent any of the disorders where the protein's hydrolytic activity is undesirable and/or deleterious such as disorders characterized by tissue degradation including but not limited to amyloidosis, colitis, lysosomal diseases, arthritis, muscular dystrophy, inflammation, tumor invasion, glomerulonephritis, parasite-borne infections, Alzheimer's disease, periodontal disease, and cancer metastasis.

In another embodiment, the invention relates to methods and compositions using the protein of the invention or part thereof as a marker protein to selectively identify tissues, preferably ovarian, liver or prostate, more preferably salivary glands. For example, the protein of the invention or part may be used to synthesize specific antibodies using any techniques known to those skilled in the art. Such tissue specific antibodies may then be used to identify tissues of unknown origin, for example, forensic samples, differentiated tumor tissue that metastasized to foreign bodily, or to differentiate different tissue types in a tissue cross-section using immunochemistry.

Protein of SEQ ID No: 398 (Internal Designation: 160-31-3-0-E4-CS)

The protein of SEQ ID No: 398 encoded by the cDNA of SEQ ID No: 157, is overexpressed in fetal brain and shows homology with diverse hydrolases. The protein of the invention also displays a motif characteristic of isochorismatase proteins from positions 17 to 147. In addition, the protein of the invention is an alternatively spliced form of an unnamed human protein.

The protein of SEQ ID NO: 398 is ethelase, an ether hydrolase. Preferred polypeptides of the invention are polypeptides comprising the amino acids of SEQ ID NO: 398 from positions 17 to 147. Other preferred polypeptides of the invention are fragments of SEQ ID NO: 398 having any of the biological activity described herein. The hydrolytic activity of the protein of the invention or part thereof may be assayed using any of the assays known to those skilled in the art including those described in U.S. Pat. Nos. 5,445,942; 5,445,956, 6,017,746 and 5,871,616 and in Rusnak et al, 1990; Biochemistry 29 1425–1435.

In another embodiment, the invention relates to methods and compositions using the protein of the invention or part thereof as a marker protein to selectively identify tissues, preferably fetal brain. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

Proteins of SEQ ID NOs: 260 and 265 (Internal Designation 116-004-3-0-A6-CS and 116-091-1-0-D9-CS Respectively)

The protein of SEQ ID NO:260 encoded by the cDNA SEQ ID NO:19 and over expressed in liver and testis is an isoform of the protein of SEQ ID NO:265 encoded by the cDNA SEQ ID NO:24 over expressed in liver. Both proteins show homology to murine EPCS26 (Hemberger M. et al., Dev. Biol. 222, 158–169 (2000)) with Genbank accession number AF250838. The proteins of SEQ ID NOs:260 and 265 contain a signal peptide (cleavage site at position 18) that could allow the export of the protein to the extracellular domain, the export to a cellular membrane or to define a particular subcellular localization. The cDNA encoding EPCS26 has been shown to be differentially expressed during the process of trophoblast invasion.

Implantation and placentation are key processes in mammalian embryonic development. They physically connect the embryo to its mother and are critical for sufficient nutrient and gaz exchange. The extraembryonic cell lineage is the first to differentiate in the developing conceptus, reflecting the importance of this cell for the establishment of fetal-maternal connections. During murine development, the outer layer of blastocyt, the mural trophectoderm, begins to differentiate into primary trophoblast giant cells on day 5 of gestation (e5). These cells invade the uterine epithelium and penetrate deeply into the stroma. At the same time, the polar trophectoderm cells continue to proliferate and form the ectoplacental cone. On e7, the outer cells of the ectoplacental cone begin to differentiate into secondary trophoblast giant cells. The invasion of uterine stroma by these cells is critical for successful placentation (Cross et al., Science 266, 1508–1518 (1994)).

Trophoblast invasion triggers secretion of proteinases that degrade extracellular matrix molecules. Mouse trophoblasts have been shown to synthesize and secrete serine proteases, matrix metalloproteinases and cysteine proteinases. Invasion of the trophoblast is a highly controlled process. The decidula restricts invasion by secreting proteinases inhibitors. Proteinases and proteinases inhibitors have antagonistic functions in implantation and placentation which may be mirrored by the reciprocity of their expression patterns (Alexander et al., Development 122, 1723–1736 (1996)).

During tumor invasion and metastasis, the degradation of the basement membranes is often accomplished by the proteinases implicated in implantation and normal trophoblast invasion (Strickland and Richards Cell 71, 355–357 (1992), Wilson et al., Proc. Natl. Acad. Sci. USA 94, 1402–1407 (1997)). Uncontrolled trophoblast invasion, as in choriocarcinomas, results in one of the most metastatic tumors known (Strickland and Richards Cell 71, 355–357 (1992)).

A deficient fonction of the protein of the invention could result in an uncontrolled trophoblast invasion, and like in choriocarcinomas results in one of the most metastatic tumors known (Strickland and Richards Cell 71, 355–357 (1992)).

The proteins of SEQ ID NOs:260 and 265, BLASTYLASE-1 and BLASTYLASE-2, play a role in proteolysis, more specifically during embryogenesis, more specifically during trophoblast invasion. The proteins of the invention or part thereof may act as secreted proteinases that degrade extracellular matrix molecules or at the contrary as proteinase inhibitors. Preferred polypeptides of the invention are polypeptides comprising the amino acids of SEQ ID NO:260 from positions 7 to 122 and the amino acids of SEQ ID NO:265 from positions 7 to 81. Other preferred polypeptides of the invention are fragments of SEQ ID NO: 260 and 265 having any of the biological activities described herein. The proteolytic activity of the proteins of the invention or part thereof may be assayed using any of the assays known to those skilled in the art including those described in U.S. Pat. Nos. 6,069,229 and 5,861,267. The protease inhibitor activity of the proteins of the invention or part thereof may be assayed using any of the assays known to those skilled in the art and using methods for determining inhibition constants well known to those skilled in the art (see Fersht, ENZYME STRUCTURE AND MECHANISM, 2nd ed., W. H. Freeman and Co., New York, (1985)).

In addition, the proteins of the invention or part thereof may be used to diagnose, treat or prevent any of the disorders characterized by undesirable and/or deleterious hydrolytic activity such as disorders characterized by tissue degradation including but not limited to amyloidosis, colitis, lysosomal diseases, arthritis, muscular dystrophy, inflammation, tumor invasion, glomerulonephritis, parasite-borne infections, Alzheimer's disease, periodontal disease, cancer metastasis, and choriocarcinoma. For diagnostic purposes, the expression of the proteins of the invention could be investigated using any of the Northern blotting, RT-PCR or immunoblotting methods described herein and compared to the expression in control individuals. Alternatively, inhibitors for the proteins'activity may be developed and use to inhibit and/or reduce its activity using any methods known to those skilled in the art. Overexpression of the proteins of the invention or part thereof may be achieved using any of the gene therapy method described herein.

In another embodiment, the invention relates to methods and compositions using the protein of the inventions or part thereof as a marker protein to selectively identify tissues, preferably liver and testis for the protein of SEQ ID NO: 260, preferably liver for the protein of SEQ ID NO: 265. For example, the proteins of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry. Antibodies that specifically bind the Blastylase 1 or 2 proteins can be used to inhibit a Blastylase activity, preferably embryonic implantation or trophoblast invasion. Also preferred are methods of inhibiting neoplastic or tumor cell invasion, either in vitro or in vivo by blocking Blastylase activity. Preferably these methods comprise the step of contacting an antibody specific for Blastylase 1 or 2 with a Blastylase 1 or 2 polypeptide under conditions that permit antigen-antibody binding.

Protein of SEQ ID NO: 265 (Internal Designation 116-088-4-0-A9-CS)

The protein of SEQ ID NO: 265 encoded by the cDNA of SEQ ID NO: 24 is overexpressed in testis and liver. This protein of the invention is homologous to the GdX protein, also named UBL4 (Toniolo et al., Proc Natl Acad Sci USA 1988;85:851–5), found in both human (GENPEPT accession number L44140) and mice species (GENPEPT accession number J04761). In addition, the 174-amino-acid-long protein of SEQ ID NO: 265, which is similar in size to ubiquitin-like proteins, displays a pfam consensus domain from position 1 to 82 that is the hallmarks of ubiquitin family proteins.

Ubiquitin is a protein of 76 amino acid residues, found in all eukaryotic cells, and which is extremely well conserved from protozoan to vertebrates (Jentsch et al., Trends Cell Biol 2000; 10:335–42). It plays a key role in a variety of cellular processes, such as ATP-dependent selective degradation of cellular proteins, maintenance of chromatin structure, regulation of gene expression, stress response, ribosome biogenesis, cell-cycle progression, signal transduction, transcription and antigen presentation (Wilkinson et al. Annu Rev Nutr 1995; 15:161–89). The first ubiquitin is covalently ligated to target proteins through an isopeptide linkage between the C-terminal glycine residue of ubiquitin and an internal $\epsilon$-amino group of lysine residue of the substrate. To generated an efficient proteasomal targeting signal, additional ubiquitin are linked to the first one by isopeptide bounds, and form branched poly-ubiquitin complexes (Thrower et al., EMBO J 2000; 19: 94–102). Covalent binding of ubiquitin to proteins marks them for subsequent degradation by a multicomponent enzymatic complex known as the 26S proteasome (Hershko et al., Annu Rev Biochem 1992; 61:761–807).

The genes coding ubiquitin-like proteins fall into two separate classes (Hershko et al., Annu Rev Biochem 1992;61:761–807). Proteins of the first class are frequently designed as ubiquitin-like modifiers, or UBLs. They produce polyubiquitin molecules consisting of exact head to tail repeats of ubiquitin, with a variable number of repeats. These linear polymer of ubiquitin are linked covalently through peptide bonds between the C-terminal glycine residue and N-terminal lysine residue of contiguous ubiquitin molecules. Proteins of the second class are habitually named as ubiquitin-domain proteins, or UDPs. These proteins bear a single domain of the N-terminal domain that is related to ubiquitin, fused to a C-terminal ribosomal domain consisting of 52 or 76–80 amino-acid residues (Finley et al., Nature 1989;338:394–401). These proteins are not conjugated to other proteins and function as an heterogeneous group of proteins. To date, this family includes RAD23, DSK2, PLIC-1, PLIC-2/Chap1, XDRP1, BAG-1, BAT3/Chap2, Scythe, Parkin, UIP28, UBP6, Elongin B, and GdX. In addition, the protein of invention of SEQ ID NO: 265 clearly belongs to the UDPs family, as it displays a single ubiquitin N-terminal consensus domain, which is the hallmark of this protein family subset.

UDPs participate to regulation of proteolysis through multiple mechanisms such as interaction with catalytically active 26S proteasome for RAD23 (Schauber et al., Nature 1998; 391:715–8), hPLIC-1 and hPLIC-2 (Kleijnen et al., Mol Cell 2000; 6:409–19), and BAG-1 (Luders et al., J Biol Chem 2000; 275:4613–7), removing ubiquitin from conjugates for UBP6 (Wyndham et al., Protein Sci 1997; 8:1268–75) and negative regulation of multi-ubiquitin chain assembly for RAD23 (Ortolan et al., Nature cell Biol 2000; 2:601–8). In addition, an increasing body of evidence indicates that some UDPs participate to other cellular functions as protein folding (Luders et al., J Biol Chem 2000; 275:4613–7), apoptosis (Kaye et al., FEBS Lett 2000; 467:348–55), and nucleotide-excision repair (de Laat et al., Genes Dev 1999; 13:768–785). UDPs family proteins have been shown directly associated with pathogenesis of several diseases including xeroderma pigmentosum for RAD23 (Masutani et al., EMBO J 1994; 13:1831–43), and Parkinson's disease for parkin (Kitada et al., Nature 1998; 392:605–8). In addition, involvement of ubiquitin-like proteins or abnormal ubiquitinated accumulation of proteins has been found in multiple human disorders. Most of them, but not all, involve nervous central system as Alzheimer's disease (van Leeuwen et al., Science 1998; 279:242–7), diffuse Lewy body disease (Iseki et al., J Neurol Sci 1997; 146:53–7), Huntington disease (Scherzinger et al., Cell 1997; 90:549–58), and amyotrophic lateral sclerosis (Leigh et al., Brain 1991; 114:775–88). In most disorders, ubiquinated-proteins accumulate within cells and form aggregates termed inclusion bodies that have characteristic appearance on histological examination. In addition, abnormal accumulation of ubiquitinated proteins has been found in Von-Hippel Lindau disease (Kamura et al., Proc Natl Acad Sci USA. 2000; 97:10430–5), and in liver of alcoholic hepatitis patients (Ohta et al., Lab Invest. 1988; 59:848–56). Components of hepatocytes are released within the circulation in alcoholic hepatitis (Sorbi et al., Am J Gastroenterol 1999; 94:1018–22)

It is believed that the protein of SEQ ID NO: 265 or part thereof plays a role in the regulation of proteolysis, preferably as an ubiquitin-like protein, more preferably as an ubiquitin-domain protein. In addition, the protein of the invention may play a role in protein folding, apoptosis and nucleotide-excision repair. Preferred polypeptides of the invention are polypeptides comprising the amino acids of SEQ ID NO:265 from positions 1 to 82. Other preferred polypeptides of the invention are fragments of SEQ ID NO:265 having any of the biological activity described herein.

In an embodiment, the invention relates to compositions and methods using the protein of the invention or part thereof to remove, identify or inhibit contaminating proteases in a sample. Compositions comprising the polypeptides of the present invention may be added to biological samples as a "cocktail" with other protease inhibitors to prevent degradation of protein samples. The advantage of using a cocktail of protease inhibitors is that one is able to inhibit a wide range of proteases without knowing the specificity of any of the proteases. Using a cocktail of protease inhibitors also protects a protein sample from a wide range of future unknown proteases which may contaminate a protein sample from a vast number of sources. Such protease inhibitor cocktails (see for example the ready to use cocktails sold by Sigma) are widely used in research laboratory assays to inhibit proteases susceptible of degrading a protein of interest for which the assay is to be performed. For example, the protein of the invention or part thereof is added to samples where proteolytic degradation by contaminating proteases is undesirable. Alternatively, the protein of the invention or part thereof may be bound to a chromatographic support, either alone or in combination with other protease inhibitors, using techniques well known in the art, to form an affinity chromatography column. A sample containing the undesirable protease is run through the column to remove the protease. Alternatively, the same methods may be used to identify new proteases.

Another embodiment of the invention relates to compositions and methods of using the protein of invention or part thereof to develop assays for the immunohistochemical detection of testicular malignant tissue, as the protein is overexpressed in such tissue. For instance, this could be used for staging lymph node testicular cancer dissemination using the techniques and methods detailed in Nazeer et al., Oncol Rep (1998); 5:1425–9. The ability to specifically visualize malignant tissues (and cells derived from the tissues), is useful for numerous applications, including to determine the origin, to identity e.g. cancerous cells, as well as to facilitate the identification of particular cells and tissues for, e.g. the evaluation of histological slides.

In another embodiment, the invention relates to compositions or methods using the protein of SEQ ID NO:265 or part thereof to diagnose, treat and/or prevent disorders including, but not limited to xeroderma pigmentosum, Von-Hippel Lindau disease, alcoholic hepatitis, in neurodegenerative diseases such as Alzheimer's disease, diffuse Lewy body disease, Huntington disease, and amyotrophic lateral sclerosis. Detection of poly-ubiquinated protein conjugates in biological samples, such as brain tissues for the diagnosis of neurodegenerative disorders or liver and serum or plasma for the diagnosis of alcoholic hepatitis, may be performed using antibodies or nucleic acid able to detect the expression of the protein of the invention using immunohistochemistry, enzyme-linked immunosorbant assay (ELISA) or any other technique known to those skilled in the art including Northern blotting, RT-PCR or immunoblotting methods described herein as well as the technique described in Mimnaugh et al., Electrophoresis 1999;20:418–28. The expression of the protein of the invention in patients' samples is then compared to the expression in control individuals.

In still another embodiment, the invention relates to compositions or methods to treat, attenuate and/or prevent disorders including, but not limited to xeroderma pigmentosum, Von-Hippel Lindau disease, alcoholic hepatitis, in neurodegenerative diseases such as Alzheimer's disease, diffuse Lewy body disease, Huntington disease, and amyotrophic lateral sclerosis using the protein of the invention, part thereof, or any other compounds developed using the present protein as nucleic acids, antibodies, or chemical substances. In a preferred embodiment, proteins or other compounds targeted against the protein of invention or part thereof may be used to treat, prevent and/or attenuate disorders in which ubiquitin-like proteins or abnormal accumulation of ubiquitininated proteins has been found and can be involved in pathogenesis of the disease. For instance, proteins or other compounds targeted against protein of SEQ ID NO: 265 can be administered to treat or attenuate symptoms of patients affected with Alzheimer's disorder or any other neurodegenerative disorders.

Protein of SEQ ID NO: 408 (Internal Designation 174-8-2-0-C10-CS)

The protein of SEQ ID NO: 408 encoded by the cDNA of SEQ ID NO:167 found in salivary gland and brain is homologous to a *drosophila melanogaster* protein thought to be transmembraneous (STR: Q9V641). The 345-amino-acid-long protein of SEQ ID NO:408 displays the Rhomboid pfam domain from positions 186 to 323 and is predicted having six transmembrane domains from positions 101 to 121, 167 to 187, 204 to 224, 243 to 263, 273 to 293, 298 to 318.

Rhomboid genes were identified in flies and in organisms as diverse as Arabidopsis, yeast, bacteria, and mammals. Human and rat homologues of Rhomboid have been identified (Pascal et al., 1998; FEBBS Lett. 429; 337–340). This very widespread conservation implies that the Rhomboid family proteins have a fundamental function within many cells. The *Drosophila* Rhomboid has six transmembrane domains and an amino terminal hydrophobic region like the protein of the invention.

The 355-amino-acid-long *Drosophila* Rhomboid protein is known to control many aspects of fly development and especially, to establish position along the dorsoventral axis and then again later to specify the fate of neuronal precursor cells. Rhomboid expression is sufficient to activate EGF receptor (EGFr) signaling in all tissues in *Drosophila* , while loss of Rhomboid mimics reduction (or loss) of EGFr signaling in almost all tissues (Guichard et al, 1999 Development; 126, 2663–2676). As in mammals, the drosophila EGF receptor controls many aspects of growth and development. Three activating ligands of the drosophila EGFr have been described, the most developmentally significant being the TGF alpha-like molecule, Spitz (Rutledge et al., 1992; Genes & Dev. 6; 1503–1517). None of the Rhomboid-like proteins from species other than *Drosophila* have clearly assigned functions. However, there is compelling genetic evidence from *Drosophila* that Rhomboid has a key role in intercellular signaling: it functions as an activator of the EGF receptor, probably by controlling the activation the TGF-like ligand Spitz (Guichard et al., 1999 Development; 126, 2663–2676). Indeed, Rhomboid expression is the principal rate-limiting step in activation of the Ras/MAP kinase pathway by the EGFr.

Like mammalian TGF alpha, Spitz is synthesized as a functionally inert transmembrane protein; subsequently, the proteolytic release of the extracellular portion of the molecule gives rise to a soluble and potent EGFr ligand (Golembo et al., 1996; Development; 122; 3363–3370). Unlike all other essential components of EGFr signaling, the expression of Rhomboid is tightly restricted to sites of signaling activity. It has been proposed that Rhomboid attains its key role in the pathway by regulating the proteolytic cleavage of Spitz (Wasserman et al., 2000; Genes & development; 14; 1651–1663). The preeminence of Rhomboid in a pathway as critical to development and growth control as the EGFr/Ras/Map kinase cascade provides a strong incentive to understand its molecular mechanism. By analogy to mammalian EGFr ligands that are similarly processed, Spitz cleavage is expected to be catalyzed by an ADAM like protease (Black et al 1998; Curr. Opin. Cell. Biol. 10; 654–659), but Rhomboid resembles no known protease.

The *Drosophila* eye has served as a useful model for studying mechanisms of EGFr and Ras signaling. At least five different roles for the receptor have been identified (for reviews see Wasserman et al., 2000; Genes & development; 14; 1651–1663), the best characterized being its function in recruiting cells into the developing ommatidium- the individual unit of the fly compound eye. Each ommatidium contains eight photoreceptors, four cone cells that secrete lens material, and an average of eight pigment cells. It has been shown that the fly EGFr has a role in regulating cell survival in the developing eye (Dominguez et al. 1998; Curr. Biol. 8; 1039–1048).

The EGFr signaling pathway has been conserved between flies and vertebrates. The EGFr family consists of four members, HER1 (c-erbB1, EGFR), HER2 (c-erbB2), HER3 (c-erbB3), HER4 (c-erbB4), expressed in a wide range of cells (Gullick W. J. 1998; Br. Cancer Res. Treat.; 52, 43–53). TGF.alpha. and its homologs have been found to be the most abundant ligands for the EGF/TGF.alpha. receptor in most parts of the brain (Kaser, et al., (1992)Brain Res Mol Brain Res: 16:316–322). There appears to be a widespread distribution of TGF.alpha. in various regions of the brain in contrast to EGF which is only present in smaller, more discrete areas, suggesting that TGF-alpha might play a physiological role in brain tissues. These numerous receptor sites for TGF.alpha in the brain suggest that TGF has an important utility in promoting normal brain cell differentiation and function.

Transforming growth factor alpha (TGF-alpha.) is a relative of epidermal growth factor (EGF) and like EGF, it exerts its effects on cells through binding to the EGF receptor. The precise physiological roll of TGF.alpha. is still not clear, although it appears to be important in eye and hair follicle development and may play a role in both the immune system and in wound healing. (See Kumar, et al.; 1995 Cell Biology International, 19:5, 373–388). The EGF family receptors currently includes four EGF receptors. The EGFR2 receptor may also be referred to as ERB-2 and this molecule is useful for a variety of diagnostic and therapeutic indications (Prigent, S. A., and Lemoine, N. R., (1992) Prog Growth Factor Res., 4:1–24). The TGF-alpha is likely a ligand for one or more of these receptors as well as for yet an identified new EGF-type receptor. Use of the TGF-alpha. can assist with the identification, characterization and cloning of such receptors. For example, the EGF receptor gene represents the cellular homolog of the v-erb-B oncogene of avian erythroblastosis virus. Over expression of the EGF-receptor or deletion of kinase regulatory segments of the protein can bring about tumorigenic transformation of cells (Manjusri, D. et al., (1991) Human Cytokines, 364 and 381).

The EGF receptor, and the related ErbB family of receptor tyrosine kinases, have indeed been much implicated in human cancer. It is commonly believed that hyperactive receptor signaling promotes dysregulates growth control and in involved in the onset of malignancy, as well as in the disruption of developmental programs. Very little, however, is known about ErbB physiological regulation in humans. The fruitfly, *Drosophila melanogaster*, has a single receptor homologous to the four ErbB receptors. As signaling mechanisms have been well conserved between flies and mammals, these results of experiments in flies are relevant to the study of the human receptors in development and disease. Two areas of recent progress are emphasized. First, a number of signal modulators have been identified, including three EGF receptor inhibitors, several of which have human homologues. Second, the signaling molecules are integrated into regulatory networks that specify the elaborate activation profiles needed in development (positive and negative feedback control of EGF receptor signaling emerges as a central theme).

It is thus important to discover whether Rhomboid-like proteins also have functions similar to those observed in *Drosophila* in other higher organisms, including mammals, because of the substantial clinical importance of the EGFr pathway.

The protein of SEQ ID NO:408, ACTIVASE, or part thereof plays a role into the control of cellular signaling. Specifically the protein of the invention or part thereof plays a role in the activation of EGFr-mediated cell signaling, through the control of the activation of EGFr ligands, such as EGF, TGF alpha and TGF alpha-like factor, through the proteolytic cleavage of such ligands. Preferred polypeptides of the invention are polypeptides comprising the amino acids of SEQ ID NO:408 from positions 186 to 323, 101 to 121, 167 to 187, 204 to 224, 243 to 263, 273 to 293, and 298 to 318. Other preferred polypeptides of the invention are fragments of SEQ ID NO:408 having any of the biological activity described herein. The proteolytic activity of the protein of the invention or part thereof as well as its involvement in regulation of cellular signalling though the activation of EGFr may be assayed using any of the assays known to those skilled in the art.

An embodiment of the invention relates to composition and methods using the protein of the invention or part thereof to identify and/or quantify the activation of EGF receptors, preferably veretebrate EGF receptors, more preferably human ErbB receptors, in a biological sample, and thus used in assays and diagnostic kits for the quantification of such activation in bodily fluids, in tissue samples, and in mammalian cell cultures. The assessment of the activation of EGF receptors may be performed using any assay familiar to those skilled in the art. Preferably, a defined quantity of the protein of the invention or part thereof is added to the sample under conditions allowing the activation of EGFr. Then, the activation of EGFr is assayed and eventually compared to a control using any of the techniques known by those skilled in the art.

The present invention also relates to diagnostic assays for detecting altered levels of the protein of the present invention in various tissues since an over-expression of the proteins compared to normal control tissue samples can detect the presence of certain disease conditions such as neoplasia, skin disorders, ocular disorders and inflammation. Assays used to detect levels of the polypeptide of the present invention in a sample derived from a host are well-known to those of skill in the art and include radioimmunoassay competitive-binding assays, Western Blot analysis and preferably ELISA assays.

This invention is also related to the use of SEQ ID No:167 or its complement as a diagnostic tool. Detection of a mutated form of the nucleotide sequence of SEQ ID No:167 of the present invention will allow a diagnosis of a disease or a susceptibility to a disease which results from underexpression of the polypeptide of the present invention for example, improper wound healing, improper neurological functioning, ocular disorders, kidney and liver disorders, hair follicular development, angiogenesis and embryogenesis Individuals carrying mutations in the human nucleotide sequence of SEQ ID No:167 of the present invention may be detected at the DNA level by a variety of techniques. Nucleic acids for diagnosis may be obtained from a patient's cells, such as from blood, urine, saliva, tissue biopsy and autopsy material. The genomic DNA may be used directly for detection or may be amplified enzymatically by using PCR (Saiki et al., (1986) Nature, 324:163–166) prior to analysis. RNA or cDNA may also be used for the same purpose. As an example, PCR primers complementary to the nucleic acid encoding a polypeptide of the present invention can be used to identify and analyze mutations thereof. For example, deletions and insertions can be detected by a change in size of the amplified product in comparison to the normal genotype. Point mutations can be identified by hybridizing amplified DNA to radiolabeled RNA or alternatively, radiolabeled antisense DNA sequences. Perfectly matched sequences can be distinguished from mismatched duplexes by RNase A digestion or by differences in melting temperatures.

In another embodiment, the protein of the invention or part thereof can be used to diagnose, treat and/or prevent disorders linked to dysregulation of growth control, such as cancer and other disorders relating to abnormal cellular differentiation, proliferation, or degeneration, including hyperaldosteronism, hypocortisolism (Addison's disease), hyperthyroidism (Grave's disease), hypothyroidism, colorectal polyps, gastritis, gastric and duodenal ulcers, ulcerative colitis, and Crohn's disease, neurodegenrative disorders such as Parkinson's and Alzheimer's diseases using any methods and/or techniques described herein. For diagnostic purposes, the expression of the protein of the invention could be investigated using any of the Northern blotting, RT-PCR or immunoblotting methods described herein and compared to the expression in control individuals. In addition, the protein of the invention or part thereof may be used to evaluate the disease progression and the clinical treatment efficiency. Inhibition of expression or activity of the protein of the invention or part thereof to inhibit EGFr activation could be achieved by many means known to those skilled in the art including those described in the present application such as antisense nucleotide, triple helix strategies, or by contacting a cell expressing ACTIVASE protein with an ACTIVASE inhibitor, such as an antibody that specifically binds to ACTIVASE and inhibits its proteolytic activity.

Protein of SEQ ID NO:291 (Internal Designation: 180-19-4-0-F4-CS)

The protein of SEQ ID No:291 encoded by the cDNA of SEQ ID No:50 is homologous to proteins of the tissue inhibitor of metalloproteinases (TIMP) family. The protein of the invention Matrix Metalloprotenase Inhibitor or MAMI (207 amino-acids) is a variant of the metalloproteinase inhibitor 1 precursor (TIMP-1, 207 amino-acids) human protein (SwissProt P01033). The protein of the invention is stronly expressed in the liver, ovary and testis.

There are many different types of collagen found in the body and they, together with other extracellular matrix components, such as elastin, gelatin, proteoglycan and fibronectin, make up a large proportion of the body's extracellular tissue. Matrix metalloproteinases (MMPs) are enzymes that are involved in the degradation and denaturation of extracellular matrix components. Collagenases, for example, are MMPs that degrade or denature collagen. A large number of different collagenases are known to exist. These include interstitial collagenases, type IV-specific collagenases and collagenolytic proteinases. Collagenases are generally specific for collagens which, in their full triple helix structure, are extremely resistant to other enzymes.

Other MMPs are involved in the degradation and denaturation of different extracellular matrix components, for example, elastin, gelatin and proteoglycan. Some MMPs are able to degrade or denature several different types of collagen and also other extracellular matrix components. For example, stromelysin degrades type IV collagen, which is found in basement membrane, and also has an effect on other extracellular matrix components such as elastin, fibronectin and cartilage proteoglycans. The ability of MMPs metalloproteinases (such as collagenase, stromelysin, and gelatinase) to degrade various components of connective tissue makes them potential targets for controlling numerous pathological processes.

The presence of tissue inhibitors of MMPs has been observed in a variety of explants and in monolayer cultures of mammalian connective tissue cells (Vater et al., 1979 and Stricklin and Wegus 1983). Not only collagenase inhibitors but also inhibitors for other MMPs, for example, gelatinase and proteoglycanase have been found. MMP inhibitors are generally unable to bind the inactive (zymogen) forms of the respective enzymes but complex readily with active forms (Murphy et al., 1981). Tissue MMP inhibitors are found, for example, in dermal fibroblasts, human lung, gingival, tendon and corneal fibroblasts, human osteoblasts, uterine smooth muscle cells, alveolar macrophages, amniotic fluid, plasma, serum and the alpha.-granule of human platelets (Stricklin and Wegus, 1983; Welgus et al., 1985; Welgus and Stricklin, 1983; Bar-Sharvit et al., 1985; Wooley et al.; 1976; and Cooper et al., 1985).

The protein of the invention is a secreted protein which tightly complexes with metalloproteinases and irreversibly inactivate them. TIMP-1 has been identified as a secretory product of platelets and alveolar macrophages Thus, an embodiment of the present invention relates to the use of a MAMI protein of the invention or a fragment thereof to inhibit the action of MMPs by directly inhibiting the enzyme activity like a conventional inhibitor. The inhibitory activity of a MMP inhibitor may be assessed by any method suitable for determining inhibitory activity of a compound with respect to an enzyme. Such methods are described in standard textbooks of biochemistry. For in vivo use, the polypeptides are delivered by means typical for biologically active protein and appropriate for the condition using methods known in the art (e.g., i.v., typically, inhaled)

In one embodiment, the protein of SEQ ID NO:291 can be used to treat and diagnose disorders associated with excessive MMP expression, such as inflammatory disorders such as rheumatoid arthritis, osteoarthritis, osteopenias such as osteoporosis, pulmonary emphysema, periodontitis, gingivitis, corneal epidermal or gastric ulceration, and tumour metastasis, invasion and growth, Paget's disease, hyperparathyroidism. MMP inhibitors are also of potential value in the treatment of neuroinflammatory disorders, including those involving myelin degradation, for example multiple sclerosis, as well as in the management of angiogenesis dependent diseases, which include arthritic conditions and solid tumour growth as well as psoriasis, proliferative retinopathies, neovascular glaucoma, ocular tumours, angiofibromas and hemangiomas. The present invention relates to a method of treating diseases in which MMPs are involved such as atherosclerotic plaque rupture, restenosis, aortic aneurysm (including abdominal aortic aneurysm and brain aortic aneurysm), congestive heart failure, left ventricular dilatation, myocardial infarction, decubital ulcers, chronic ulcers or wounds, renal disease, or other autoimmune or inflammatory diseases dependent upon tissue invasion by leukocytes, Crohn's disease, acute respiratory distress syndrome, asthma, chronic obstructive pulmonary disease, Alzheimer's disease, organ transplant toxicity, cachexia, allergic reactions, allergic contact hypersensitivity, epidermolysis bullosa, loosening of artificial joint implants, stroke, cerebral ischemia, head trauma, spinal cord injury, neuro-degenerative disorders (acute and chronic), Huntington's disease, Parkinson's disease, migraine, depression, peripheral neuropathy, pain, cerebral amyloid angiopathy, nootropic or cognition enhancement, amyotrophic lateral sclerosis, ocular angiogenesis, macular degeneration, abnormal wound healing, burns, diabetes, scleritis, AIDS, sepsis, septic shock.

In another embodiment, MAMI polypeptides are used in the treatment or diagnosis of atherosclerosis. The rupture of atherosclerotic plaques is the most common event initiating coronary thrombosis. Destabilization and degradation of the extracellular matrix surrounding these plaques by MMPs has been proposed as a cause of plaque fissuring. The shoulders and regions of foam cell accumulation in human atherosclerotic plaques show locally increased expression of gelatinase B, stromelysin-1, and interstitial collagenase. In situ zymography of this tissue revealed increased gelatinolytic and caseinolytic activity (Galla, et al., J. Clin. Invest., 1994; 94:2494–2503). In addition, high levels of stromelysin RNA message have been found to be localized to individual cells in atherosclerotic plaques removed from heart transplant patients at the time of surgery (Henney, et al., Proc. Nat'l. Acad. Sci., 1991; 88:8154–8158).

In another embodiment, the protein of the invention has utility in treating or detecting degenerative aortic disease associated with thinning of the medial aortic wall. Increased levels of the proteolytic activities of MMPs have been identified in patients with aortic aneurysms and aortic stenosis (Vine N. and Powell J. T., Clin. Sci., 1991; 81:233–239).

In another embodiment, the protein of the invention can be used as a treatment or diagnostic tool for heart failure and associated ventricular dilatation. Heart failure arises from a variety of diverse etiologies, but a common characteristic is cardiac dilation which has been identified as an independent risk factor for mortality (Lee, et al., Am. J. Cardiol., 1993;72:672–676). This remodeling of the failing heart appears to involve the breakdown of extracellular matrix. MMPs are increased in patients with both idiopathic and ischemic heart failure (Reddy, et al., Clin. Res., 1993; 41:660A; Tyagi S. C., et al., Clin. Res., 1993; 41:681A). Animal models of heart failure have shown that the induction of gelatinase is important in cardiac dilation (Armstrong, et al., Can. J. Cardiol., 1994; 10:214–220), and cardiac dilation precedes profound deficits in cardiac function (Sabbah, et al., Am. J. Physiol., 1992; 263:H266-H270).

In another embodiment, the protein of the invention is useful in treating or detecting neointimal proliferation, leading to restenosis, frequently developed after coronary angioplasty. The migration of vascular smooth muscle cells (VSMCs) from the tunica media to the neointima is a key event in the development and progression of many vascular diseases and a highly predictable consequence of mechanical injury to the blood vessel (Bendeck M. P., et al., Circulation Research, 1994; 75:539–545). Northern blotting and zymographic analyses indicated that gelatinase A was the principal MMP expressed and excreted by these cells. Further, antisera capable of selectively neutralizing gelatinase A activity also inhibited VSMC migration across basement membrane barrier. (Pauly R. R., et al., Circulation Research, 1994; 75:41–54).

In another embodiment, the protein of the invention is used to ensure normal kidney function, which is dependent on the maintenance of tissues constructed from differentiated and highly specialized renal cells. Those cells are in a dynamic balance with their surrounding extracellular matrix (ECM) components (Davies M. et al., Kidney Int., 1992; 41:671–678). Effective glomerular filtration requires that a semi-permeable glomerular basement membrane (GBM) composed of collagens, fibronectin, enactin, laminin and proteoglycans is maintained. A structural equilibrium is achieved by balancing the continued deposition of ECM proteins with their degradation by specific MMPs. These proteins are first secreted as proenzymes and are subsequently activated in the extracellular space. These proteinases are in turn subject to counter balancing regulation of their activity by naturally occurring inhibitors as TIMPs.

Deficiency or defects in any component of the filtration barrier may have catastrophic consequences for longer term renal function. For example, in hereditary nephritis of Alport's type, associated with mutations in genes encoding ECM proteins, defects in collagen assembly lead to progressive renal failure associated with splitting of the GBM and eventual glomerular and interstitial fibrosis. In contrast, in inflammatory renal diseases such as glomerulonephritis, cellular proliferation of components of the glomerulus often precede obvious ultrastructural alteration of the ECM matrix. Cytokines and growth factors implicated in proliferative glomerulonephritis such as interleukin-1, tumor necrosis factor, and transforming growth factor beta can upregulate metalloproteinase expression in renal mesangial cells (Martin J. et al., J. Immunol., 1986; 137:525–529; Marti H. P. et al., Biochem. J., 1993; 291:441–446; Marti H. P. et al., Am. J. Pathol., 1994; 144:82–94). These metalloproteinases are believed to be intimately involved in the aberrant tissue remodeling and cell proliferation characteristic of renal diseases, such as, IgA nephropathy which can progress to through a process of gradual glomerular fibrosis and loss of functional GBM to end-stage renal disease. Metalloproteinase expression has already been well-characterized in experimental immune complex-mediated glomerulonephritis such as the anti-Thy 1.1 rat model (Bagchus W. M., et al., Lab. Invest., 1986; 55:680–687; Lovett D. H., et al., Am. J. Pathol., 1992; 141:85–98).

In another embodiment, the protein of the invention is used in methods of treating inflamed or diseased gingiva comprising contacting the gingival with an efficient amount of MAMI polypeptides. Preferably, the MAMI polypeptide is delivered as a mouthwash or lavage or in a gell form. Collagenase and stromelysin activities have been demonstrated in fibroblasts isolated from inflamed gingiva (Uitto V. J., et al., J. Periodontal Res., 1981; 16:417–424), and enzyme levels have been correlated to the severity of gum disease (Overall C. M., et al., J. Periodontal Res., 1987; 22:81–88).

In another embodiment, the protein of the invention is useful for treating or detecting ulcers. Proteolytic degradation of extracellular matrix has been observed in corneal ulceration following alkali bums (Brown S. I., et al., Arch. Opthalmol., 1969;81:370–373). Thiol-containing peptides inhibit the collagenase isolated from alkali-burned rabbit corneas (Burns F. R., et al., Invest. Opththamol., 1989;30:1569–1575). Stromelysin, a member of the MMP family, is produced by basal keratinocytes in a variety of chronic ulcers (Saarialho-Kere U. K., et al., J. Clin. Invest., 1994;94:79–88). Stromelysin-1 mRNA and protein were detected in basal keratinocytes adjacent to but distal from the wound edge in what probably represents the sites of proliferating epidermis. Stromelysin-1 may thus prevent the epidermis from healing. MAMI may be used to inhibit Stromelysin-1, thereby enhance healing or decrease healing time.

In another embodiment, the protein of the invention can be used to inhibit angiogenesis, preferably tumor angiogenesis. This activity can be assayed in models of tumor angiogenesis (Taraboletti G., et al., Journal of the National Cancer Institute, 1995; 87:293; and Benelli R., et al., Oncology Research, 1994; 6:251–257). Davies et al., (Cancer Res., 1993; 53:2087–2091) reported that a peptide decreased the tumor burden and prolonged the survival of mice bearing human ovarian carcinoma xenografts. A peptide of the conserved MMP propeptide sequence was a weak inhibitor of gelatinase A and inhibited human tumor cell invasion through a layer of reconstituted basement membrane (Melchiori A., et al., Cancer Res., 1992; 52:2353–2356), and the natural tissue inhibitor of metalloproteinase-2 (TIMP-2) also showed blockage of tumor cell invasion in in vitro models (DeClerck Y. A., et al., Cancer Res., 1992; 52:701–708). Studies of human cancers have shown that gelatinase A is activated on the invasive tumor cell surface (Strongin A. Y., et al., J. Biol. Chem., 1993; 268:14033–14039) and is retained there through interaction with a receptor-like molecule (Monsky W. L, et al., Cancer Res., 1993; 53:3159–3164). Tumor angiogenesis, preferably sarcomas and carcinomas, may be inhibited by contacting tumor cells with an effective amount of a MAMI polypeptide. When used to inhibit tumor cells in vivo, the MAMI polypeptides are preferably delivered i.v. in an effective to inhibit tumor angiogenesis.

In another embodiment, the MAMI proteins of the invention can be used to treat and diagnose rheumatoid arthritis. Collagenases have been implicated in a number of diseases, including, rheumatoid arthritis (Mullins, D. E. et al 1983), and it has been proposed to use MMP inhibitors in the treatment of this condition. Several investigators have demonstrated consistent elevation of stromelysin and collagenase in synovial fluids from rheumatoid and osteoarthritis patients as compared to controls (Walakovits L. A., et al., Arthritis Rheum., 1992; 35:35–42; Zafarullah M., et al., J. Rheumatol., 1993; 20:693–697). MAMI polypeptides can prevent the formation of collagen fragments from the degradation of both the bovine nasal and pig articular cartilage in models for arthritis (Andrews H. J., et al., Biochem. Biophys. Res. Commun., 1994; 201:94–101).

In another embodiment, the protein of the invention is used to treat inflammation by contacting the site of inflammation with effective amount of a MAMI polypeptide of the present invention. Gijbels et al., (J. Clin. Invest., 1994; 94:2177–2182) recently described a peptide that suppressed the development or reversed the clinical expression of experimental allergic encephalomyelitis (EAE) in a dose dependent manner, suggesting the use of MMP inhibitors in the treatment of autoimmune inflammatory disorders such as multiple sclerosis. A recent study by Madri has elucidated the role of gelatinase A in the extravasation of T-cells from the blood stream during inflammation (Ramanic A. M. and Madri J. A., J. Cell Biology, 1994; 125:1165–1178). This transmigration past the endothelial cell layer is coordinated with the induction of gelatinase A and is mediated by binding to the vascular cell adhesion molecule-1 (VCAM-1). Once the barrier is compromised, edema and inflammation are produced in the CNS. Leukocytic migration across the blood-brain barrier is known to be associated with the inflammatory response in EAE. Inhibition of the metalloproteinase gelatinase A by MAMI will block the degradation of extracellular matrix by activated T-cells that is necessary for CNS penetration. Therefore, inhibition of stromelysin-1 and/or gelatinase A by MAMI polypeptides is useful in the treatment of diseases involving disruption of extracellular matrix resulting in inflammation due to lymphocytic infiltration, inappropriate migration of metastatic or activated cells, or loss of structural integrity necessary for organ function.

The present invention provides the use of an MMP inhibitor in the manufacture of a medicament for the treatment or prophylaxis of scars. Collagen is the major component of scar and other contracted tissue and as such is the most important structural component to consider. Contraction of tissues comprising extracellular matrix components, especially of collagen-comprising tissues, may occur in connection with many different pathological conditions and with surgical or cosmetic procedures. Contracture, for example, of scars, may cause physical problems, which may lead to the need for medical treatment, or it may cause problems of a purely cosmetic nature. These methods of preventing scar formation, comprise the step of contacting a wound, such as an incision, with a scar preventing effective amount of a MAMI polypeptide of the present invention.

During experiments on in vitro models of scar contraction, collagen appears to be invaded and permanently remodelled by fibroblasts and that such invasion and remodelling is inhibited by collagenase inhibitors. The remodelling generally appears as contraction of the collagen, the contraction of which is inhibited by inhibition of collagenase. Furthermore, inhibition of other MMPs also results in inhibition of contraction.

The present invention also provides the use of an MMP inhibitor in the treatment or prophylaxis of a natural or artificial tissue comprising extracellular matrix components to inhibit, i.e. restrict, hinder or prevent, contraction of the tissue, especially contraction resulting from a pathological condition or from surgical or cosmetic treatment.

Cosmetic treatments, such as chemical or physical dermal abrasion, used as anti-ageing treatments, cause trauma to the skin. Use of MMP inhibitors, such as a MAMI polypeptide, during the healing process which occurs after the initial abrasion is a cosmetic use of MMP inhibitors according to the present invention.

The present invention also provides the use of an MMP inhibitor to inhibit, i.e. restrict, hinder or prevent, invasion by cells, especially fibroblasts, into tissue comprising an extracellular matrix and/or migration by cells, especially fibroblasts, in or through tissue comprising an extracellular matrix. The method comprises the step of contacting the fibroblasts or extracellular matrix with MMP inhibitors, preferably a MAMI polypeptide in an effective amount.

In another embodiment, the present protein is used to prevent or reduce contracture of scar tissue resulting from eye surgery. Glaucoma surgery to create new drainage channels often fails due to scarring and contraction of tissues. A method of preventing contraction of scar tissue formed in the eye, such as the application of a suitable agent, is therefore invaluable. Such an agent may also be used in the control of the contraction of scar tissue formed after corneal trauma or corneal surgery, for example laser or surgical treatment for myopia or refractive error in which contraction of tissues may lead to inaccurate results. It is also useful in cases where scar tissue is formed on/in the vitreous humor or the retina, for example, that which eventually causes blindness in some diabetics and that which is formed after detachment surgery, called proliferative vitreoretinopathy. Other uses include where scar tissue is formed in the orbit or on eye and eyelid muscles after squint, orbital or eyelid surgery, or thyroid eye disease and where scarring of the conjunctiva occurs as may happen after glaucoma surgery or in cicatricial disease, inflammatory disease, for example, pemphigoid, or infective disease, for example, trachoma. A further eye problem associated with the contraction of collagen-comprising tissues for which the methods and medicaments of the present invention may be used is the opacification and contracture of the lens capsule after cataract extraction. These methods comprise the step of contacting the affected part of the eye with an effective amount of a MAMI polypeptide.

In a preferred embodiment, the protein of the invention can be used for the treatment of burns. Contraction of collagen-comprising tissue, which may also comprise other extracellular matrix components, frequently occurs in the healing of burns. The burns may be chemical, thermal or radiation burns and may be of the eye, the surface of the skin or the skin and the underlying tissues. It may also be the case that there are burns on internal tissues, for example, caused by radiation treatment. These methods comprise the step of contacting the burn with an effective amount of a MAMI polypeptide.

A further aspect of the present invention is the inhibition of the contraction of skin grafts. Skin grafts may be applied for a variety of reasons and may often undergo contraction after application. As with the healing of burnt tissues the contraction may lead to both physical and cosmetic problems. It is a particularly serious problem where many skin grafts are needed as, for example, in a serious burns case. These methods comprise the step of contacting the skin graft with an effective amount of a MAMI polypeptide.

An associated area in which the medicaments and methods of the present invention are of great use is in the production of artificial skin. To make a true artificial skin it is necessary to have an epidermis made of epithelial cells (keratinocytes) and a dermis made of collagen populated with fibroblasts. It is important to have both types of cells because they signal and stimulate each other using growth factors. A major problem up until now has been that the collagen component of the artificial skin often contracts to less than one tenth of its original area when populated by fibroblasts. MMP inhibitors, for example, MAMI polypeptides may be used to inhibit the contraction to such an extent that the artificial skin can be maintained at a practical size by contacting said fibroblasts or artificial skin with an effective amount of a MAMI polypeptide.

Protein of SEQ ID NO:276 (157-15-4-0-B11-CS)

The protein of SEQ ID NO:276, encoded by the cDNA of SEQ ID NO:35, is a variant of a testis-specific isoform of human calpastatin protein (Genseq accession number W19395). The protein of SEQ ID NO:276 contains 2 potential transmembrane segments (position 5 to 25 and position 109 to 129) predicted by the software TopPred II (Claros and von Heijne, CABIOS applic. Notes, 10:685–686 (1994)), and a signal peptide (position 8: LAVILTLLGLAIL/AI). Like the human calpastatin protein (Genseq accession number W19395), the protein of SEQ ID NO:276 is over-represented in testis.

Calpastatin is a physiological inhibitor of calpains. Calpains are Ca2+-activated cytosolic proteases, are thought to participate in cytoskeletal remodeling events, cellular adhesion, shape change, and mobility by the site-specific regulatory proteolysis of membrane- and actin-associated cytoskeletal proteins (Beckerle et al., Cell 51:569–577, 1987; Yao et al., Am. J. Physiol. 265(pt. 1):C36–46, 1993; and Shuster et al., J. Cell Biol. 128:837–848, 1995). Calpains have also been implicated in the pathophysiology of cerebral and myocardial ischemia, platelet activation, NF-kB activation, Alzheimer's disease, muscular dystrophy, cataract progression and rheumatoid arthritis. There is considerable interest in inhibitors of calpain, as cellular adhesion, cytoskeletal remodeling events and cell mobility are linked to numerous pathologies (Wang et al., Trends in Pharm. Sci. 15:412419, 1994; Mehdi, Trends in Biochem. Sci. 16:150–153, 1991). In addition, as the calpain/calpastatin system is involved in membrane fusion events for several cell types, and calpain can be detected in human sperm and testes extracts by Western blotting with specific antisera, tCAST may modulate calpain in the calcium-mediated acrosome reaction that is required for fertilization (Li S et al., Biol Reprod, 63(1):172–8, 2000).

Calpastatin consists of a unique N-terminal domain (domain L) and four repetitive protease-inhibitor domains (domains 1–4) (Lee W J et al., J Biol Chem, 267(12):8437–42, 1992). The isolated cDNAs from various mammalian species have conspicuous differences in the regions encoding the N-terminal sequences and can be classified into four types. Alternative splicing is most likely the cause for the molecular diversity (Lee W J et al., J Biol Chem, 267(12):8437–42, 1992). Type IV (or human tCAST), a shorter isoform, is specifically expressed in testis (Takano J et al., J Biochem Tokyo; 128(1):83–92, 2000). Human tCAST consists of a 40-amino-acid N-terminal T domain plus a part of domain II and all of domains III and IV from the somatic isoform. The protein of SEQ ID NO:276, INHIBICAL, shows extensive homology to the N-terminal region of the testis basic specific protein (U60665) and the human calpastatin protein (W19395). The homologous region corresponds to domain T and II of the human calpastatin protein (W19395). The T domain targets cytosolic localization and membrane association of tCAST, whereas domain I of somatic calpastatin proteins (sCAST) exhibits a nuclear localization function (Li S et al., Biol Reprod, 63(1): 172–8, 2000).

Inhibical is a member of the calpastatin family and, as such, plays a role in cytoskeletal remodeling events, cellular adhesion, shape change, and mobility by the site-specific regulatory proteolysis of membrane- and actin-associated cytoskeletal proteins. Preferred polypeptides of the invention are polypeptides comprising the amino acids of SEQ ID NO:276 from positions 1 to 119. Other preferred polypeptides of the invention are any fragments of SEQ ID NO:276 having any of the biological activities described herein.

One embodiment of the present invention relates to methods of using an inhibical polypeptide of the invention or part thereof in assays to detect the presence of calpain in a biological sample, such as in bodily fluids, in tissue samples, or in mammalian cell cultures. As calpastatin can bind calpain (Murachi, Biochemistry Int., 18(2)263–294, 1989), the protein of the invention can be used in assays and diagnostic kits to test the presence of calpain using techniques known to those skilled in the art. Preferably, a defined quantity of the protein of the invention (labeled or unlabeled) or calpain binding part thereof is added to the sample under conditions allowing the formation of a complex between the protein of the invention or part thereof, and the presence of the complex and/or the free protein of the invention or part thereof is assayed and compared to a control (either directly or indirectly using a secondary antibody or other detection system). Calpastatin has been shown to be useful as a marker of intracellular calpain activation, and can be used for monitoring the involvement of calpain in pathological situations (De Tullio et al., FEBS letter, 475(1):17–21, 2000). Calpain has been implicated in cytoskeletal protein degradation involved in the pathophysiology of ischemia and disorders like Alzheimer's disease (Wronski et al., J. Neural transm., 107(2):145–157, 2000), apoptosis in neural cells of rat with spinal cord injury (SCI) (Ray, Brain res., 867(1–2):80–9, 2000), cell fusibility (Kosower et al., Methods Mol Biol., 144:181–94, 2000) and other physiopathologies. Assays detecting any increased calpain level in a cell would thus allow the diagnosis of any of the herein-described diseases or conditions. In addition, a recent study showed that in addition to their proteolytic activities on cytoskeletal proteins and other cellular regulatory proteins, calpain-calpastatin systems can also affect expression levels of genes encoding structural or regulatory proteins (Chen et al., Am. J. Physiol. Cell Physiol, 279:C709–C716, 2000). Thus, the ability to detect calpastatin and calpain levels will likely be useful for the diagnosis of an even larger number of diseases and conditions.

In another embodiment, the polynucleotides or polypeptides of the invention may be used for the detection of gametes, or of specific structures within the gametes, using any technique known to those skilled in the art, including those involving the use of specific anti-inhibical antibodies and nucleic acid probes. Various studies have shown that calpastatin is present in the sperm acrosome (Li et al., Bio. of Reprod., 63:172–178, 2000), and more precisely between the plasma membrane and outer acrosomal membrane of cynomolgus macaque spermatozoa (Yudin A I, J Androl, 21(5):721–9, 2000). The ability to visualize spermatozoa generally, or the sperm acrosome in particular, has obvious utility for a number of applications, including for the analysis of infertility in patients, as described below.

Another embodiment of the present invention relates to a method of inhibiting a calpain in a cell. Various studies have shown that it is possible to inhibit calpains dose dependently in cell free protease activity assays: the calpain inhibitor Cerebrolysin can protect microtubule associated protein 2(MAP2) in a rat model of acute brain ischemia (Wronski et al., J. Neural Transm. Suppl., 59:263–272, 2000), and E-64-D, a cell permeable and selective inhibitor of calpain, can attenuate calpain activity associated with apoptosis in rat SCI (Ray et al., Brain Res., 867(1–2) 80–9, 2000). Similarly, inhibical polypeptides can be used to inhibit calpain in vitro or in vivo. As calpain has been implicated in a number of pathological processes, diseases, and conditions, such as the pathophysiology of cerebral and myocardial ischemia, platelet activation, NF-kB activation, Alzheimer's disease, muscular dystrophy, cataract progression and rheumatoid arthritis, any of these diseases or conditions can be treated or prevented by increasing or decreasing the activity or expression of the present protein in cells of a mammal affected by the disease or condition. Such an increase can be effected in any of a number of ways, including, but not limited to introducing a polynucleotide encoding the protein of the invention, operably linked to a promoter, into a cell; and by administering to a cell a compound that increases the activity or expression of the protein of the invention. In addition, the expression or activation of the protein of the invention can be inhibited in any of a large number of ways, including using antisense oligonucleotides, antibodies, dominant negative forms of the protein, and using heterologous compounds that decrease the expression or activation of the protein. Such compounds can be readily identified, e.g. by screening candidate compounds and detecting the level of expression or activity of the protein using any standard assay.

In another preferred embodiment, the protein of the invention can be used to modulate and/or characterize fertility, including for the treatment or diagnosis of infertility, and for contraception. As the calpain/calpastatin system has been implicated in the acrosomal reaction which is a required step in fertilization, it is likely that the over- or under-expression or activation of the present protein disrupts this reaction, thereby inhibiting fertility. Thus, the cause of infertility in many patients can likely be detected by detecting the level of expression of the present protein, where an abnormal level of activity or expression of the protein indicates that a cause of infertility involves the calpain-dependent acrosomal reaction. Such a diagnosis would also point to methods of treating the infertility, e.g. by increasing or decreasing the expression or activation of the protein in spermatozoa. Alternatively, for contraception, the expression or activation of the protein can be artificially disrupted, for example by increasing the protein level using polynucleotides encoding the protein, using the protein itself, or using activators of protein expression or activity, or by decreasing the protein level using inhibitors such as antisense oligonucleotides, antibodies, dominant negative forms of the protein, and using heterologous compounds that inhibit protein expression or activity.

Protein of SEQ ID NO: 295 (Internal Designation 181-20-3-0-B5-CS)

The protein of SEQ ID NO:295, Immodulin, encoded by the cDNA of SEQ ID NO:54, shows homology to the rat, bovine, and human uromodulin precursor, Tamm-Horsfall urinary glycoprotein, and thuman pancreatic secretory granule membrane major glycoprotein GP2 precursor. SEQ ID NO:295 exhibits homology in the 5' region (over 40% identical and 60% similar) to both GP2 and uromodulin. Like GP2 and uromodulin, the homologous segment contains EGF-like calcium-binding domains, several potential disulfide bonds, and a number of potential N-linked glycosylation sites. Calcium binding EGF-like domains contain a calcium-binding site at the N-terminus, and have been found in proteins which require calcium for their biological activity. Non-limiting examples of proteins which contain calcium-binding EGF-like domains include: (1) Coagulation Factors X, VII, IX; (2) LDL receptors; (3) thrombomodulin; and (4) fibrillin-1. Downing et al. [Cell 85:597–605 (1996)] described disease-causing mutations that destabilized a covalently-linked pair of $Ca^{2+}$-binding EGF-like domains in fibrillin-1 (associated with Marfan Syndrome). These domains form a rigid rod-like arrangement, stabilized by interdomain calcium binding and hydrophobic interaction. Uromodulin (URO) is a 90–100 KDa glycoprotein synthesized by epithelial cells of the ascending loops of Henle and convoluted tubule of the bladder. Except for glycosylation, URO is identical to Tamm-Horsfall protein (THP), the most abundant protein in normal human urine. The relative abundance and specific nephronal location of URO suggests that it may have important physiologic functions in the urinary system.

URO has also been found to be an immunosuppressive glycoprotein, inhibiting antigen-induced human T-cell proliferation. More recent studies have shown that URO can trigger the inflammatory response of neutrophils and stimulate human mononuclear cells to proliferate and release cytokines and gelatinase.

Uromodulin has been shown to play a role in regulating the circulating activity of cytokines since it binds to recombinant interleukin-1 and -2 and tumor necrosis factor (TNF) with high affinity. Although URO does not inhibit the cytotoxic activity of TNFα as monitored by lysis of tumor cell targets, it interacts with recombinant TNFα via carbohydrate chains. This interaction may be critical in promoting clearance and/or reducing in vivo toxicity of TNFα and other lymphokines. Endotoxic shock and sepsis are caused by cytokines IL-1 and TNFα. Since URO appears to exhibit inhibitory activity against IL-1 and TNFα, URO may be effective as a therapeutic agent against these conditions. Uromodulin has also been implicated as a possible inhibitor of certain types of bacterial infection in the bladder and urinary tract. URO has the ability to bind to type 1 pilus of *Escherichia coli* and prevent attachment to the surface of epithelium.

SEQ ID NO:295 also has homology to the glycoprotein GP-2. GP-2 is an integral protein of the pancreatic zymogen granule membrane. GP2 is anchored to the lipid bilayer via a glycosyl phosphatidylinositol (GPI) linkage and released by a calcium-activated enzyme into the content of the zymogen granule. Through the process of exocytosis, GP2 is discharged into the pancreatic duct. The protein is also soluble in the zymogens stored in the granule, secreted by the pancreas, and detected in the pancreatic secretions. GP2 appears to play a role in progression of pancreatitis, an inflammation of the pancreas accompanied by autodigestion of pancreatic tissue by its own enzymes. After cloning and sequencing of GP2, a search of the Genbank database revealed one homologous protein, namely uromodulin. Studies reveal that GP2 and URO not only share structural homology, but functionally are similar in that both can form ductal precipitates under pathological conditions. The aggregation of these precipitates in the pancreas may lead to obstruction of the pancreatic ducts and play a critical role in development of pancreatitis. Similarly, aggregation of URO in the kidney may lead to blockage of the renal tubules and result in renal disease.

The subject invention provides for Immodulin polypeptide and polynucleotide sequences encoding Immodulin. Also included in the invention are biologically active fragments of Immodulin and polynucleotide sequences encoding these biologically active fragments. "Biologically active fragments" are defined as those peptide or polypeptide fragments of SEQ ID NO:295 which have at least one of the biological functions of the full length protein (e.g., the ability to chelate calcium, bind to *E. coli* pili, or cause immunomodulation of an individual). In one embodiment, the polypeptides of SEQ ID NO:295 are interchanged with the Immodulin polypeptides encoded by the human cDNA of clone 181-20-3-0-B5-CS.

The invention also provides for Immodulin variants. These variants have at least about 80%, more preferably at least about 90%, and most preferably at least about 95% amino acid sequence identity to the amino acid sequence of SEQ ID NO:295. Variants according to the subject invention also have at least one functional or structural characteristic of SEQ ID NO:295, such as the biological functions described above or EGF-like calcium-binding domains. The invention also provides biologically active fragments of the variant proteins. Unless otherwise indicated, the methods disclosed herein can be practiced utilizing SEQ ID NO:295, or variants thereof. Likewise, the methods of the subject invention can be practiced using biological fragments of Immodulin, or variants of said biologically active fragments.

Because of the redundancy of the genetic code, a variety of different DNA sequences can encode Immodulin (SEQ ID NO:2950. It is well within the skill of a person trained in the art to create these alternative DNA sequences which encode proteins having the same, or essentially the same, amino acid sequence. These variant DNA sequences are, thus, within the scope of the subject invention. As used herein, reference to "essentially the same sequence" refers to sequences that have amino acid substitutions, deletions, additions, or insertions that do not materially affect biological activity.

"Recombinant nucleotide variants" are alternate polynucleotides which encode a particular protein. They can be synthesized, for example, by making use of the "redundancy" in the genetic code. Various codon substitutions, such as the silent changes which produce specific restriction sites or codon usage-specific mutations, can be introduced to optimize cloning into a plasmid or viral vector or expression in a particular prokaryotic or eukaryotic host system, respectively.

SEQ ID NO:295, and variants and fragments thereof, can be used to produce antibodies according to methods well known in the art. The antibodies can be monoclonal, polyclonal or otherwise as described herein. Antibodies can also be synthesized against fragments SEQ ID NO:295 as well as variants of SEQ ID NO:295 according to known methods. The subject invention also provides antibodies which specifically bind to biologically active fragments of SEQ ID NO:295 or biologically active fragments of variants of SEQ ID NO:295.

The subject invention also provides for immunoassays which are used to screen for, monitor, or diagnose conditions or disorders associated with liver dysfunction and/or damage. These conditions or disorders include, and are not limited to, hepatitis, cirrhosis, fibrosis, pericholangitis, portal triaditus, chronic periportal inflammation, systemic lupus erythematosus, Hodgkin's disease, Granulomas, and cell dysplasia can also be diagnosed. For a number of disorders listed above, expression of these genes at significantly higher or lower levels can be routinely detected in certain liver tissues or cell types (e.g., cancerous) or bodily fluids (e.g., serum, plasma, and blood) taken from an individual having such a disorder, relative to the standard gene expression levels, e.g., the expression level in healthy tissue or bodily fluid from one or more individuals not having the disorder. These types of assays allow for a non-invasive method of screening for, diagnosing, or monitoring liver cancer in human subjects. Similarly, antibodies and small molecules directed to the polypeptides can be used as immunological probes for differential identification of the diseased tissue(s) or cells.

Additionally, nucleic acid and amino acid sequences of SEQ ID NOs:54 and 295 can be used to provide polypeptides and biologically active fragments thereof for the repair of cellular injury following liver damage and/or liver transplant.

Furthermore, polypeptides, or biologically active fragments thereof, can be used for the modulation of bacterial binding to epithelial cells or as a modulator of bacterial infection. In this aspect of the subject invention, bacterial cells are contacted with an amount of a composition comprising the polypeptide, or biologically active fragments thereof, sufficient to interfere with the binding of bacteria to epithelial cells. In one embodiment, the bacteria are coliform bacterial cells. In another embodiment, the bacterial cells are *E. coli*. Compositions comprising SEQ ID NO:295, or biologically active fragments thereof, can be administered in any fashion required to provide a therapeutic effect (e.g., orally, intravenously, intrathecally, intraarterially, etc.).

The subject invention also provides materials and methods for the treatment of endotoxic shock and/or sepsis. In this embodiment, a subject can be treated with therapeutically effective amounts of a composition comprising SEQ ID NO:295, or biologically active fragments thereof.

The subject invention also provides materials and methods for the in vivo or in vitro chelation of calcium ions ($Ca^{2+}$). In this aspect of the invention, SEQ ID NO:295, or biologically active fragments thereof, can be used to bind free Ca$^{2+}$ by addition of the polypeptide, or biologically active fragments thereof, to solutions, environmental samples, or biological samples. Alternatively, a composition containing the SEQ ID NO:295, or biologically active fragments thereof, can be added to the solutions, environmental samples, or biological samples in amounts sufficient to bind and remove free Ca$^{2+}$ from solution.

In another aspect of the subject invention, SEQ ID NO:295, or biologically active fragments thereof, can be used to negatively modulate the immune system of a mammal. In this method, immunomodulatory amounts of SEQ ID NO:295, or biologically active fragments thereof, can be administered to a mammal in a pharmaceutically acceptable carrier to downregulate/suppress the immune system, preferably Tcells. Methods of assessing the stimulated state of the immune system of the mammal can be practiced according to methods well known in the art.

Protein of SEQ ID NOs:244, 251 (Internal Designation Numbers 105-016-3-0-G10-CS and 105-074-3-0-H10-CS)

The 274 amino acid protein of SEQ ID NO:244, encoded by the cDNA of SEQ ID NO:3, found in prostate and strongly expressed in the salivary gland, presents strong sequence similarities with the yeast putative mitochondrial carrier protein PET8 (SWISSPROT accession number P38921) and with similar proteins conserved among eukaryotes (*D. melanogaster* and *C. elegans*: respective SPTREMBLNEW SPTREMBL SWISSPROT accession numbers Q9VBN7 and Q18934, and *S. pombe*: SWISSPROT accession number: Q10442). All members of the mitochondrial carrier/transport protein superfamily exhibit sequence motifs highly similar to P-X-D/E-X-X-K/R-X-R that are also found in 3 positions in the protein of the invention (positions 26 to 33, 108 to 115 and 199 to 206) (Belenkiy et al, Biochim. Biophys. Acta, 1467:207–218 (2000)). These mitochondrial carrier protein signatures are associated with membrane-spanning segments (Belenkiy et al, ibid; Kuan et Saier, Crit. Rev. Biochem. Mol. Biol., 28:209–233 (1993)). In fact, 4 candidate membrane-spanning segments are identified in the protein of the invention, from amino acid positions 4 to 24, 51 to 71, 180 to 200 and 240 to 260. Other hydrophobic regions are found in positions 86 to 107 and 139 to 162. In addition, the protein of SEQ ID NO:244 presents a putative signal peptide in its very amino-terminal part (position 5 to 19).

The protein of SEQ ID NO:251, encoded by the cDNA of SEQ ID NO:10, is a 72 amino acid truncated form of the protein of SEQ ID NO:244. This shorter product results from the absence, in the cDNA of SEQ ID NO:10, of the 110 bp exon (position 275 to 384) found in the cDNA of SEQ ID NO:3. Nevertheless, the 72 amino acid encoded protein possesses the putative signal peptide (position 5 to 19), the first mitochondrial carrier protein signature (position 26 to 33), and two candidate membrane-spanning segments (positions 4 to 24 and 51 to 71).

Energy transduction in mitochondria requires the transport of many specific metabolites across the inner membrane of this eukaryotic organelle. Different types of substrate carrier proteins involved in energy transfer are found in the inner membrane. These proteins all seem to be evolutionary related, and constitute the mitochondrial carrier/transport proteins (MCP/MTP) superfamily. Structurally, MCP/MTP proteins are typically homodimeric integral transmembrane polypeptides (subunit molecular weight ~30 kD) that traverse the inner mitochondrial membrane six times with both the N- and C-termini localized to the cytosolic side of the membrane. Each 30 kD subunit is composed of three tandem repeats of a domain of approximately one hundred residues (~10 kD). This 10 kD domain contains two transmembrane regions and a sequence motif highly similar to P-X$_1$-D/E-X$_2$-X$_3$-K/R-X$_4$-R, where X$_3$ is a hydrophobic residue (Kuan et Saier, Crit. Rev. Biochem. Mol. Biol., 28:209–233 (1993)). Five protein families of known function have been identified among the mitochondrial carrier protein superfamily:

(1) The ADP, ATP carrier protein (ACC), ADP/ATP translocases, which under the conditions of oxidative phosphorylation catalyze the one to one exchange of cytosolic ADP against matrix ATP across the inner mitochondrial membrane (Fiore et al, Biochimie, 80:137–150 (1998)). The ADP/ATP transport system can be blocked very specifically by two families of inhibitors: atractyloside (ATR) and carboxyatractyloside (CATR) on one hand, and bongkrekic acid (BA) and isobongkrekic acid (isoBA) on the other hand. It is well established that these inhibitors recognise two different conformations of the carrier protein, the CATR- and BA-conformations, which exhibit different chemical, immunochemical and enzymatic reactivities. Bakker and collaborators have reported that myopathies might result from a defect in ADP/ATP transport (Bakker et al, Pediatr. Res. 33:412–417 (1993)). Namely, the authors describe a 4-fold decrease in the concentration of the ADP/ATP carrier protein in a patient with a mitochondrial myopathy.

(2) The 2-oxoglutarate/malate carrier protein (OGCP), which exports 2-oxoglutarate into the cytosol and imports malate, or other dicarboxylic acids, into the mitochondrial matrix. This protein plays an important role in several metabolic processes, such as the malate/aspartate and the oxoglutarate/isocitrate shuttles (Palmieri et al, J. Bioenerg. Biomembr. 25:493–501 (1993)).

(3) The phosphate group carrier protein, which transports inorganic phosphate groups from the cytosol into the mitochondrial matrix (Palmieri et al, ibid).

(4) The mammalian brown fat uncoupling proteins, such as UCP-1 (thermogenin), are transmembrane proton-translocating proteins present in the mitochondria of brown adipose tissue, a specialized tissue which functions in heat generation and energy balance ((Jezek and Garlid, Int. J. Biochem. Cell. Biol. 30:1163–1168 (1998); Klingenberg, J. Bioenerg. Biomembr. 31:419–430 (1999); Nicolls and Locke, Physiol. Rev. 64:2–40 (1994); Rothwell and Stock, Nature 281:31–35 (1979)). Mitochondrial oxidation of substrates is accompanied by proton transport out of the mitochondrial matrix, creating a transmembrane proton gradient. Typically, re-entry of protons into the matrix via ATP synthase is coupled to ATP synthesis. However, UCP-1 functions as a transmembrane proton transporter, permitting re-entry of protons into the mitochondrial matrix unaccompanied by ATP synthesis. Environmental exposure to cold evokes neural and hormonal stimulation of brown adipose tissue, which increases UCP mediated proton transport, brown fat metabolic activity, and heat production.

Studies with transgenic models indicate that brown fat and UCP-1 play an important role in energy expenditure in rodents. Transgenic mice in which brown adipocyte tissue was ablated by a toxin coupled to the UCP-promoter developed obesity and diabetes (Lowell et al., Nature 366:740–742 (1993)). Obesity in these transgenic animals developed in the absence of hyperphagia, suggesting that the uncoupled mitochondrial respiration of brown fat is an important component of energy expenditure. In a separate transgenic mouse model, ectopic expression of UCP-1 in white adipose tissue of genetically-obese mice led to a significant reduction in body weight and fat stores (Kopecky et al., J. Clin. Invest. 96:2914–2923 (1995)). These studies indicate that activity of UCP-1 is accompanied by energy expenditure and weight loss in rodents. Two other UCP proteins have recently been cloned. The first uncoupling protein-like protein (UCPL) or UCP-2 (59% homologous), is widely expressed (heart, kidney, lung, placenta and white fat) and enriched in tissues of the lymphoid lineage (Fleury et al., Nature Genetics 15:269–272 (1997)). The second, UCP-3 3 (57% homologous), is predominantly localized to skeletal muscle and brown fat (Boss et al., FEBS Lett. 408:39–42 (1997)). UCP-3 has been found to be regulated by cold and thyroid hormone (Larkins et al., Biochem. Biophys. Res. Comm. 240:222–227 (1997)).

Thermogenic protein activity, such as that found with UCP-1, may be useful in reducing, or preventing the development of, excess adipose tissue, such as that found in obesity. Obesity is becoming increasingly prevalent in developed societies. Attempts to reduce food intake, or to decrease hypernutrition, are usually fruitless in the medium term because the weight loss induced by dieting results in both increased appetite and decreased energy expenditure (Leibel et al., New Engl. J. Med. 322:621–628 (1995)). The intensity of physical exercise required to expend enough energy to materially lose adipose mass is too great for many obese people to undertake on a sufficiently frequent basis. Thus, obesity is currently a poorly treatable, chronic, essentially intractable metabolic disorder. In addition, obesity carries a serious risk of co-morbidities including, Type 2 diabetes, increased cardiac risk, hypertension, atherosclerosis, degenerative arthritis, and increased incidence of complications of surgery involving general anesthesia.

(5) The tricarboxylate transport protein (or citrate transport protein), which is involved in citrate-H+/malate exchange. This protein is important for the bioenergetics of hepatic cells as it provides a carbon source for fatty acid and sterol biosyntheses, and NAD for the glycolytic pathway (Kaplan et al, J. Biol. Chem. 268:13682–13690 (1993)).

It is believed that the protein of SEQ ID NO:244 or part thereof is a member of the mitochondrial carrier/transport protein superfamily and, as such, plays a role in mitochondrial processes such as ADP/ATP, malate/aspartate, 2-oxoglutarate/isocitrate, citrate-H+/malate exchanges across the inner membrane, phosphate groups transport and physiological roles such as regulation of body weight and energy balance, muscle nonshivering thermogenesis, fever, and defense against the generation of reactive oxygen species. Preferred polypeptides of the invention are polypeptides comprising the amino acids of SEQ ID NO:244 from amino acid positions 26 to 33, 108 to 115 and 199 to 206 on one hand, and from positions 4 to 24, 51 to 71, 86 to 107, 139 to 162, 180 to 200 and 240 to 260 on the other hand. Other preferred polypeptides of the invention are fragments of SEQ ID NO:244 having any of the biological activities described herein. It is believed that the protein of SEQ ID NO:251 is a 72 amino acid truncated form of the 274 amino acid protein of SEQ ID NO:244, and corresponds to one subunit of the tripartite structure of mitochondrial carrier/transport proteins. Preferred polypeptides are polypeptides comprising the amino acids of SEQ ID NO:251 from positions 4 to 24, 26 to 33 and 51 to 71.

The activity of the protein of the invention can be assessed using cultured cells. For example, nucleic acids encoding the protein of SEQ ID NO:244 can be cloned into a eukaryotic vector and transfected into a population of cells. Transfected mammalian cells are then tested for their carrier activity e.g., the import of ADP, dicarboxylic acids, inorganic phosphate groups, or $H^+$ into the mitochondrial matrix, and the export of ATP, 2-oxoglutarate, tricarboxylate-$H^+$ export into the cytosol. These transfected cell lines may allow the development of in vitro assays for the identification of modulators of the carrier activity, such as atractyloside (ATR), carboxyatractyloside (CATR), bongkrekic acid (BA) and isobongkrekic acid (isoBA), which were described above in connection with the ADP/ATP mitochondrial carrier. Such modulators are useful for the treatment of any diseases or conditions associated with the protein of the invention.

Another embodiment of the invention relates to compositions and methods using the protein of the invention or part thereof to label mitochondria, or more specifically the inner mitochondrial membrane, in order to visualize any change in number, topology or morphology of this organelle, for example in association with a mitochondria-related human disorder, such as neuroleptic malignant syndrome (NMS) (Kubo et al., Forensic Sci. Int. 115:155–158 (2001)), the Rett syndrome (Armstrong, Brain Dev. 14 Suppl:S89–98 (1992)), Alpers disease (Chow and Thorburn, Hum. Reprod. 15 Suppl 2:68–78 (2000)) or mitochondrial encephalomyopathies (Handran et al., Neurobiol. Dis. 3:287–298 (1997)). For example, the protein may be rendered easily detectable by inserting the cDNA encoding the protein of the invention into a eukaryotic expression vector in frame with a sequence encoding a tag sequence. Eukaryotic cells expressing the tagged protein of the invention may also be used for the in vitro screening of drugs or genes capable of treating any mitochondria-related disease or conditions. The protein of the invention can also be used to specifically label cells of the salivary gland or of the prostate, e.g. for histological analyses or for the identification of the origin of tumor cells.

The protein of the invention can also be used as a carrier/transporter to translocate radiolabeled or chemically labeled metabolites (ADP, dicarboxylic acids, inorganic phosphate groups) from the cytosol to the matrix of the mitochondria in order to specifically label this organelle, e.g. to follow its modifications. For example, radiolabeled or chemically labeled precursors can be added to an in vitro culture of mammalians cells stably transfected and expressing the protein of the invention. The labeling of the organelles can then be stopped at different times after the beginning of the experiment by adding specific inhibitors of carrier/transporter proteins, such as atractyloside (ATR), carboxyatractyloside (CATR), bongkrekic acid (BA), or isobongkrekic acid (isoBA). Cells with labeled mitochondria can be used for the in vitro screening of drugs or genes capable of causing mitochondrial modifications.

Still another embodiment of the invention or part thereof relates to methods of delivering heterologous compounds, either polypeptides or polynucleotides, to the inner membrane of mitochondria by recombinantly or chemically fusing a fragment of the protein of the invention to a heterologous polypeptide or polynucleotide. Preferred fragments are the putative peptide signal, the four membrane-spanning segments and/or any other fragments of the protein of the invention that may contain targeting signals for mitochondria including but not limited to matrix targeting signals as defined in Herrman and Neupert, Curr. Opinion Microbiol. 3:210–4 (2000); Bhagwat et al. J. Biol. Chem. 274:24014–22 (1999), Murphy Trends Biotechnol. 15:326–30 (1997); Glaser et al. Plant Mol Biol 38:311–38 (1998); Ciminale et al. Oncogene 18:4505–14 (1999). Such heterologous compounds may be used to modulate mitochondrial activities, such as to induce and/or prevent mitochondrial-induced apoptosis or necrosis. For example, these heterologous compounds may be used in the treatment and/or the prevention of disorders in which apoptosis is deleterious, including, but not limited to, immune deficiency syndromes (including AIDS), type I diabetes, pathogenic infections, cardiovascular and neurological injury, alopecia, aging, degenerative diseases such as Alzheimer's Disease, Parkinson's Disease, Huntington's disease, dystonia, Leber's hereditary optic neuropathy, schizophrenia, and myodegenerative disorders such as "mitochondrial encephalopathy, lactic acidosis, and stroke" (MELAS), and "myoclonic epilepsy ragged red fiber syndrome" (MERRF). In addition, heterologous polynucleotides may be used to deliver nucleic acids for mitochondrial gene therapy, i.e. to replace a defective mitochondrial gene and/or to inhibit the deleterious expression of a mitochondrial gene.

The invention further relates to methods and compositions used to modify the protein of the invention. Post-translational modifications encompassed by the invention include, N-linked or O-linked carbohydrate chains, processing of N-terminal or C-terminal ends, attachment of chemical moieties to the amino acid backbone, chemical modifications of N-linked or O-linked carbohydrate chains, and addition or deletion of an N-terminal methionine residue as a result of prokaryotic host cell expression. These post-translational modifications of the protein of the invention may be very useful in the search for its putative protein partners, using approaches such as screening of an expression cDNA library with a radiolabeled recombinant protein, as post-translational modifications are of first importance in protein-protein interactions. Identification of proteinic partners of mitochondrial carrier proteins would allow the study of their regulation ex vivo and in vivo in normal versus pathologic cases (for an example concerning the UCP1 mitochondrial carrier protein and its 14.3.3 physical partner, see: Pierrat et al., Eur. J. Biochem. 267:2680–2687 (2000)).

Another embodiment of the invention relates to composition and methods using polynucleotide sequences encoding the protein of the invention or part thereof to establish transgenic model animals (*D. melanogaster, M. musculus*), by any method familiar to those skilled in the art. By modulating in vivo the expression of the transgene with drugs or modifier genes (activator or suppressor genes), animal models can be developed that mimic human mitochondria-associated disorders such as myopathies or obesity. These animal models would thus allow the identification of potential therapeutic agents for treatment of the disorders. In addition, recombinant cell lines derived from these transgenic animals may be used for similar approaches ex vivo.

In one embodiment, the protein of SEQ ID NO:251, corresponding to the 72 amino acid truncated form of SEQ ID NO:244, may be used as a dominant negative variant to inhibit the function of the full-length form of the protein of SEQ ID NO:244 in vitro or in vivo. Inactivation of mitochondrial carriers in this way may allow the development of animal models for human disorders. Recently, for example, Lowell and collaborators have shown in the mouse that a targeted destruction of UCP1 by the diphteria toxin A chain is able to produce obese animals (Kozak and Koza, ibid., Lowell et al., ibid.).

Protein of SEQ ID NO: 285 (Internal Designation 174-39-2-0-A3-CS)

The protein of SEQ ID NO:285, Redoxitase encoded by the cDNA of SEQ ID NO: 44 (clone 174-39-2-0-A3-CS), is overexpressed in cancerous prostate, fetal brain, muscle and placenta. Thus, the protein as polynucleotides can be used for diagnosis or detection of these cancers by detecting overexpression of Redoxitase in RNA or protein. The method comprises the step of contacting a biological sample with polynucleotide probe or anti-redoxitase antibody under conditions that allow the binding of the probe to Redoxitase MRNA or Redoxitase protein and comparing the amount of Redoxitase MRNA or Protein in a normal sample with a biological sample from a cancer. Overexpression of Redoxitase indicates the presence of cancer cells. The protein is homologous to the NADH-cytochrome b5 reductase isoform and to the human electron transport protein.

NADH-cytochrome b5 reductase proteins belong to a flavoenzyme family sharing common structural features and whose members (ferrodoxin-NADP+ reductase, NADPH-cytochrome P450 reductase, NADPH-sulfite reductase, NADH-cytochrome b5 reductase and NADH-nitrate reductase) are involved in photosynthesis, in the assimilation of nitrogen and sulfur, in fatty-acid oxidation, in the reduction of methemoglobin and in the metabolism of many pesticides, drugs and carcinogens (Karplus et al., Science, 251:60–6 (1991)). In addition, cytochrome b5 reductase is thought to play a role in the prevention of apoptosis following oxidative stress (see review by Villalba et al., Mol Aspects Med 18 Suppll:S7–13 (1997)).

It is believed that the protein of SEQ ID NO: 285 may be an oxidoreductase. Thus it may play a role in electron transport and general aerobic metabolism and may be associated with mitochondrial membranes. In addition, the protein of the invention may be able to use FAD and/or molybdopterin as cofactors. It may be involved in photosynthesis, in the assimilation of nitrogen and sulfur, in fatty-acid oxidation, in the reduction of methemoglobin and in the metabolism of many pesticides, drugs and carcinogens. Preferred polypeptides of the invention are fragments of SEQ ID NO: 285 having any of the biological activity described herein. The oxidoreductase activity of the protein of the invention may be assayed using any technique known to those skilled in the art. The ability to bind a cofactor may also be assayed using any techniques well known to those skilled in the art including, for example, the assay for binding NAD described in U.S. Pat. No. 5,986,172.

In another embodiment, the protein of the invention or part thereof is used to prevent cells from undergoing apoptosis. In a preferred embodiment, the apoptosis active polypeptide is added to an in vitro culture of mammalian cells in an amount effective to reduce apoptosis. Furthermore, the protein of the invention or part thereof may be useful in the diagnosis, the treatment and/or the prevention of disorders in which apoptosis is deleterious, including but not limited to immune deficiency syndromes (including AIDS), type I diabetes, pathogenic infections, cardiovascular and neurological injury, alopecia, aging, degenerative diseases such as Alzheimer's Disease, Parkinson's Disease, Huntington's disease, dystonia, Leber's hereditary optic neuropathy, schizophrenia, and myodegenerative disorders such as "mitochondrial encephalopathy, lactic acidosis, and stroke" (MELAS), and "myoclonic epilepsy ragged red fiber syndrome" (MERRF).

The invention further relates to methods and compositions using the protein of the invention or part thereof to diagnose, prevent and/or treat several disorders in which energy metabolism is impaired, or needs to be impaired, including but not limited to mitochondriocytopathies, necrosis, aging, neurodegenerative diseases, myopathies, methemoglobinemia, hyperlipidemia, obesity, cardiovascular disorders and cancer. For diagnostic purposes, the expression of the protein of the invention could be investigated using any of the Northern blotting, RT-PCR or immunoblotting methods described herein and compared to the expression in control individuals. For prevention and/or treatment purposes, the protein of the invention may be used to enhance electron transport and increase energy delivery using any of the gene therapy methods described herein.
Protein of SEQ ID NO:368 (Internal Designation 187-45-0-0-118-CS)

The protein of SEQ ID NO: 368 encoded by the cDNA of SEQ ID NO: 127 is a 78 amino acids long polypeptide. The sequence of the protein of SEQ ID NO: 368 is identical to the sequence of the human Dad1 protein, the defender against apoptotic cell death 1 protein, a subunit of the mammalian oligosaccharyltransferase (OST), except that the last 43 residues of Dad1 are replaced by a series of 8 different amino acids in the protein of the invention. In addition, the protein of SEQ ID NO: 368 displays the pfam signature for DAD family proteins from positions 1 to 78 as well as two putative transmembrane domains from positions 31 to 51 and 54 to 74. The Dad1 protein is a 113 amino acids long protein which mRNA is composed of 3 exons [see Genbank accession number D15057 and Nakashima, T. et al (1993) *Molecular and Cellular Biology* 13:6367–6374]. The cDNA of SEQ ID NO: 127 is composed of the first and third exon of the Dad1 cDNA wheras the second exon of the Dad1 cDNA is missing. Taken together, these datas indicate that the protein of SEQ ID NO: 127 is a new isoform of the Dad1 protein resulting from an alternative splicing event.

Asparagine-linked glycosylation is a highly conserved protein modification reaction that occurs in all eukaryotes. The initial stage in the biosynthesis of N-linked glycoproteins, catalysed by the enzyme oligosaccharyltransferase (OST), involves the transfer of a preassembled high-mannose oligosaccharide from a dolichol-linked oligosaccharide donnor onto asparagine acceptor sites in nascent proteins in the lumen of the rough endoplasmic reticulum [for review, see Silberstein, S. et al (1996) *FASEB J* 10: 849–858].

Protein glycosylation is essential for the structure and function of many proteins and is involved in the control of many diverse biological processes (Paulson, *Trends in Biol. Sci.*, 1989, 14, 272; Sadler, *In Biology of Carbohydrates*, 2nd Ed., Ginsburg & Robbins, Ed., John Wiley & Sons: New York, 1984, Vol. 2, pg. 87). For example, protein glycosylation has been found to be crucial for the development, growth and proper function of complex organisms, while the aberrant glycosylation of proteins has been associated with diseased and transformed cells.

The mammalian oligosaccharyltransferase is composed of the four ER membrane proteins, ribophorin I and II (RI and RII), OST48, and DAD1, which form an oligomeric complex. RI and OST48, and probably also RII, are type I transmembrane proteins. The luminal domain of OST48 interacts with those of RI and RII and the cytoplasmic domain of OST48 has affinity for the cytoplasmically exposed N-terminal tail of DAD1 [Kelleher, D. et al. (1997) *Proc Natl. Acad. Sci. USA* 94: 4994–4999; Fu, J. et al (1997) *J. Biol. Chem* 272: 29687–29692].

Dad1 is a small hydrophobic protein, thought to be an integral membrane protein, with a cytoplasmically located N terminus and up to three transmembrane domains. As is true for the other subunits of OST, the precise role of Dad1 in N-glycosylation is not known. However, it has been shown that Dad1 is critical for the function and the structural integrity of the OST complex [Sanjay, A. et al. (1998) *J. Biol. Chem* 273: 26094–26099]. Also, it is worth noting that the Dad1 protein was first identified in 1993 as a mammalian cell death suppressor since loss of its function induces apoptosis in hamster BHK21 cells [Nakashima, T. et al (1993) *Molecular and Cellular Biology* 13:6367–6374].

Since then, several reports have confirmed the anti-apoptotic role for Dad1 [Hong, N A. et al, (2000) *Dev Biol* 220:76–84; Brewster, J L. et al, (2000) *Genesis* 26: 271–8); Yoshimi, M. et al, (2000) *Biochem Biophys Res Commun* 276: 965–9].

Dad1 is a highly conserved protein whose sequence has been determined for diverse organisms including several vertebrates, a nematode, and several plants. A comparaison of these sequences reveals that the amino-terminal region preceding the first membrane-spanning segment is the least conserved region of the protein both with repect to lengh and amino acid sequence identity. The most highly conserved sequences of Dad1 include the second and third membrane spanning segments, making them probably the most crucial regions for Dad1 function [Kelleher, D. et al. (1997) *Proc Natl. Acad. Sci. USA* 94: 4994–4999]. The importance of the C-terminus region for mediating Dad1 functions has been recently confirmed [Makishima, T. et al, (2000) *J. Biochem (Tockyo)* 128:399–405]

Therefore, Dad1 acts as a positive regulator of the oligosaccharyltransferase complex, and as a negative regulator of apoptosis. In addition, the C-terminus of the Dad1 protein seems to be important for mediating these functions. As mentioned above, the protein of the invention is a new isoform of the Dad1 protein resulting from an alternative splicing event. As a result of this alternative splicing event, the C-terminus of the protein of the invention is shortened and does not display the third transmembrane domain of Dad1. Since the C-terminus of Dad1 has been shown to be important for mediating the protein function, the protein of the invention has an antagonistic action to the one of Dad1. It is worth noting that this type of situation in which the same gene give rise by alternative splicing to different protein products with opposing functions is a commun theme among apoptosis genes [For a review, see Reed, J C. (1999) *Nat. Biotechnol* 17: 1064–65].

Thus, POP polynucleotides play a role in the control of N-glycosylation of celullar proteins. The protein of the invention is also a positive regulator of apoptosis and a negative regulator of the OST complex. Preferred polypeptides of the invention are polypeptides comprising the amino acids of SEQ ID NO: 368 from positions 1 to 78, and 71 to 78. Other preferred polypeptides of the invention are fragments of SEQ ID NO: 368 having any of the biological activity described herein. The activity of the protein of the invention or part thereof on protein N-glycosylation may be assayed using any of the assays known to those skilled in the art. For example, one could use DNA-mediated gene transfer techniques in order to introduce the cDNA sequence of SEQ ID NO: 127 or part thereof into cell lines so that the protein of SEQ ID NO: 368 or part thereof is over expressed in these cell lines. The resulting effect of this over expression on the N-glycosylation of proteins can then be detected using immunoblotting or Western blotting of glycoproteins [Makishima et al. (1997) *Genes Cells* 2: 129–141; Silberstein et al. (1995) *J. Cell. Biol*: 131: 371–383; Hong et al. (2000) *Developmental Biology* 220. The activity of the protein of the invention or part thereof on cellular apoptosis may be assayed using any of the assays known to those skilled in the art including those described by Nakashima et al. (1993) supra.

One object of the present invention are compositions and methods of targeting heterologous polypeptides to the endoplasmic reticulum by recombinantly or chemically fusing a fragment of the proteins of the invention to an heterologous polypeptide. Preferred fragments are any fragments of the proteins of the invention, or part thereof, that may contain targeting signals for the endoplasmic reticulum such as those described in Pidoux A L, Armstrong EMBO J 1992 April;11 (4):1583–91; Munro S, Pelham H R Cell 1987 Mar. 13;48 (5):899–907; Pelham H R Trends Biochem Sci 1990 December;15(12):483–6.

In another embodiment, the invention relates to compositions and methods using the protein of the invention or part thereof to stimulate cells' entry into apoptosis. In a preferred embodiment, the pro-apoptosis POP protein of the invention or pro-apoptosis part thereof is added to an in vitro culture of mammalian or plant cells in an amount effective to stimulate apoptosis. In another preferred embodiment, the cDNA sequence of SEQ ID NO: 127 or part thereof may be used to create transgenic animals or plant cells in which the disclosed protein of the invention or part thereof can be expressed at higher levels than normal whenever and wherever it is desired. Ways to create transgenic cells in which the expression of the transgene can be turn on or off whenever it is desired are well known in the art. Increasing the expression level of the protein of the invention in cells to stimulate programmed cell death may be useful for applications in which a given species of cells become undesirable upon a given event, i.e., infection, transformation, end of a production process, etc.

Furthermore, the invention relates to methods and compositions using the protein of the invention or part thereof to diagnose, prevent and/or treat disorders characterized by abnormal cell proliferation and/or programmed cell death, including but not limited to cancer, immune deficiency syndromes (including AIDS), type I diabetes, pathogenic infections, cardiovascular and neurological injury, alopecia, aging, degenerative diseases such as Alzheimer's Disease, Parkinson's Disease, Huntington's disease, dystonia, Leber's hereditary optic neuropathy, schizophrenia, and myodegenerative disorders such as "mitochondrial encephalopathy, lactic acidosis, and stroke" (MELAS), and "myoclonic epilepsy ragged red fiber syndrome" (MERRF). For diagnostic purposes, the expression of the protein of the invention could be investigated using any of the Northern blotting, RT-PCR or immunoblotting methods described herein and compared to the expression in control individuals. For prevention and/or treatment purposes of disorders in which cell proliferation needs to be reduced and/or apoptosis increased, the expression of protein of the invention may be enhanced using any of the gene therapy methods described herein or known to those skilled in the art. For prevention and/or treatment purposes of disorders in which cell proliferation needs to be enhanced and/or apoptosis reduced, inhibition of endogenous expression of the protein of the invention may be achieved using any methods or known to those skilled in the art including the triple helix and antisense strategies described herein.

Moreover, antibodies to the protein of the invention or part thereof may be used for detection of the endoplasmic reticulum for histological purposes using any techniques known to those skilled in the art.

Protein of SEQ ID No: 284 (Internal Designation 174-38-3-0-C9-CS)

The protein of SEQ ID No: 284 encoded by the cDNA of SEQ ID No: 43 is overexpressed in salivary gland. The 406-amino-acid-long protein of invention, which is similar in size to fucosyltransferases, displays a Pfam motif of the fusosyltransferase family from residues 70 to 406. Furthermore, the present protein of invention is homologous to a putative fucosyltransferase of *Drosophila* melanogaster (STR accession number: Q9VLC1 and Q9VLC1). The protein of SEQ ID 284 also shares homology with the alpha1, 3 fucosyltransferase (E.C. 2.4.1.152), found in Brachydanio renio (EMBL accession number: AB023627), Schistosoma mansoni (GENPEPT accession number: AF183577–1), cattle (SPTREMBL accession number: Q9TQQ3), and human species (GENPEPT accession number: AJ132772_2). Like fucosyltransferases, the protein of the invention displays the features of type II transmembrane proteins with a short N-terminal cytoplasmic tail, a 9–29 amino acid signal-anchor transmembrane domain, and a large C-terminal domain. Furthermore, the present protein of invention displays an almost perfect consensus motif of the alpha-1,3 fucosyltransferases from residues 315 to 345 (Breton et al. Glycobiology 1998; 1: 87–94).

Fucosyltransferases are a family of enzymes that catalyze the transfer of fucose from GDP-fucose, to galactose in an alpha1,2 linkage, and to N-acetylglucosamine in alpha1,3-, alpha1,4- and alpha1,6-linkages. Since all fucosyltransferases use the same nucleotide sugar, their specificity will probably reside in the recognition of the acceptor and in the type of linkage formed. In human species, fucosyltransferases, which are type II membrane proteins found in Golgi, can be split into three distinct families (Breton et al. Glycobiology 1998; 1: 87–94): (1) the alpha-1,2-fucosyltransferases, hFUT1 and hFUT2, which yield nearly identical products as only single carbohydrate linkage differentiates type I from type II glycans. hFUT1 determines the expression of O-type antigen (H antigen) of the ABO blood group system on erythrocytes, whereas hFUT2 (Se) determines it in saliva, i.e. secretor status; (2) The alpha-1, 3-fucosyltransferases that constitute a distinct homogenous family of proteins, although some regions display similarities with the alpha-1,2 and alpha-1,6-fucosyltranferases (Breton et al. Glycobiology 1998;1:87–94). Five alpha-1,3-fucosyltransferases have been characterized to date in the human species, i.e. hFUT3 (Lewis enzyme), hFUT4 (myeloid-type), hFUT5, hFUT6 (plasma-type), and hFUT7. These are involved in the lasts steps of the biosynthesis the carbohydrate antigen sialyl Lewis of ABH (de Vries et al. J Biol Chem 1995; 270:8712–22; Kimura et al. Biochem Biophys Res Commun 1997 8;237:131–7); (3) The alpha-1,6-fucosyltransferase, hFUT8, which is implicated in the synthesis of N-glycans (Miyoshi et al. Biochim Biophys Acta 1999; 1473:9–20).

The fucosylated cell surface glycoconjugates play important roles in physiological and pathological processes, such as fertilization, embryogenesis, lymphocyte trafficking, immune response, and cancer metastasis (Staudacher et al. Trends Glycosci Glycotechnology 1996; 8:391–408). More specifically, the fucosylated cell surface glycoconjugates, which are present on the apical surface of various epithelium, contribute to resistance of various microorganisms agents including bacteria as *Helicobacter pylori* (Umesaki et al. Science 1997;276:964–5), and *E. coli* (Vogeli et al. Schweiz Arch Tierheilkd 1997;139:479–84), and virus such as HIV (Ali et al. Infect Dis 2000;181:737–9). On the other hand, abnormal upregulation of fucosyltransferases is a common finding in various types of tumors, which cause an increased production of fucosylated glycoconjugates. Such fucosylated glycoconjugates can also serve as tumor markers and include (1) the Ca19-9 cancer antigen, which circulating sialyl-Lewis a structure produced by hFUT3 and used for diagnosis of pancreatic and gastric cancer (Koprowski et al. Somatic Cell Genet 1979; 5:957–71), and (2) alpha-foetoprotein whose alpha 1,6-fucosylatation is reduced in hepatoma (Miyoshi et al. Biochim Biophys Acta. 1999; 1473:9–20). On the other hand, aberrant production of fucosylated glycoconjugates can provide selective growth advantage by facilitating the extravasation of tumor cells, since they participate to endothelial adhesion through interaction with E- and P-selectins of endothelial cells (Butcher and Picker, Science 1996; 272:60–6). Consequently, modulation of fucosyltransferase activity can modify tumorogenicity in various model of tumors including hepatoma (Miyoshi et al. Biochim Biophys Acta. 1999; 1473:9–20), and colorectal adenocarcinoma (Weston et al. Cancer Res 1999;59:2127–35).

The protein of the invention of SEQ ID NO:284 is a glycosyltransferase, specifically an hexosyltransferase, more specifically a fusosyltransferase, even more specifically an alpha-1,3-fucosyltransferase, and as such plays a role in fertilization, embryogenesis, lymphocyte trafficking, immune response, cancer metastasis and resistance to various microorganisms. Preferred polypeptides of the invention are polypeptides comprising the amino acids of SEQ ID NO:284 from positions 70 to 406, and 315 to 345. Other preferred polypeptides of the invention are fragments of SEQ ID NO:284 having any of the biological activity described herein. The glycosyltransferase activity of the protein of the invention or pat thereof may be assayed using any of the assays known to those skilled in the art including those described in (Palcic et al. Carbohydr Res 1990; 196:133–40).

Fucosylated compounds have considerable potential both as therapeutics and as reagents for clinical assays. However, synthesis of glycosylated compounds of potential commercial and/or therapeutic interest is difficult because of the very nature of the saccharide subunits. A multitude of positional isomers in which different substituent groups on the sugars become involved in bond formation, along with the potential formation of different anomeric forms, are possible. As a result of these problems, large scale chemical synthesis of most carbohydrates is not possible due to economic considerations arising from the poor yields of desired products. Enzymatic synthesis using glycosyl transferases such as fucosyltransferase provides an alternative to chemical synthesis of carbohydrates. Enzymatic synthesis using glycosidases, glycosyl transferases, or combinations thereof, have been considered as a possible approach to the synthesis of carbohydrates. As a matter of fact, enzyme-mediated catalytic synthesis would offer dramatic advantages over the classical synthetic organic pathways, producing very high yields of carbohydrates economically, under mild conditions in aqueous solutions, and without generating notable amounts of undesired side products. To date, such enzymes are however difficult to isolate, especially from eukaryotic, e.g., mammalian sources, because these proteins are only found in low concentrations, and tend to be membrane-bound. In addition to being difficult to isolate, the acceptor (peptide) specificity of glycosyl transferases is poorly understood. Thus, there is a need for obtaining recombinant glycosyl transferase, including fucosyltransferases, that could be produced in very large amounts.

Thus, the invention related to methods and compositions using the protein of the invention or part thereof to synthesize glycosylated compounds, either glycoproteins, glycolipids, or oligosaccharides, more particularly fucosylated compounds. If necessary, the protein of the invention or part thereof may be produced in a soluble form by removing its transmembrane domains and/or its Golgi retention signal using any of the methods skilled in the art including those described in U.S. Pat. No. 5,776,772. For example, the protein of the invention or part thereof is added to a sample containing GDP-fucose and a substrate compound in conditions allowing glycosylation, more particularly fucosylation and allowed to catalyze the glycosylation of this compound. In a preferred embodiment, the enzymatic reaction carried out by the protein of the invention is part of a series of other chemical and/or enzymatic reactions aiming at the synthesis of complex glycosylated compounds, such as the ones described in U.S. Pat. Nos. 5,409,817 and 5,374,541. In another preferred embodiment where the method is to be practiced on a commercial scale, it may be advantageous to immobilize the glycosyltransferase on a support. This immobilization facilitates the removal of the enzyme from the batch of product and subsequent reuse of the enzyme. Immobilization of glycosyltransferases can be accomplished, for example, by removing from the transferase its membrane-binding domain, and attaching in its place a cellulose-binding domain. One of skill in the art will understand that other methods of immobilization could also be used and are described in the available literature.

In a preferred embodiment embodiment, the present invention relates to processes and compositions for producing glycosylated compounds, preferably fucosylated compounds, wherein a cell is genetically engineered to produce the protein of the invention or part thereof and used in combination with one or several other cells able to produce the donor substrate for the protein of the invention.

In another preferred embodiment, the present invention relates to a process and compositions for controlling the glycosylation of proteins in a cell wherein an insect, plant, or animal cell is genetically engineered to produce one or more enzymes that provide internal control of the cell's glycosylation mechanism. Preferably, the invention relates to a Chinese hamster ovary (CHO) cell line that is genetically engineered to produce a fucosyltransferase of the present invention either alone or in combination with other glycosyltransferases. This supplemental fucosyltransferase modifies the glycosylation machinery to produce glycoproteins having carbohydrate structures that more closely resemble naturally occurring human glycoproteins. The methods for performing the above process and making the above compositions are carried out using the methods known in the art and described in U.S. Pat. No. 5,047,335.

Another embodiment of the present invention relates to compositions and methods using the protein or part thereof to detect fucosylated conjugates. In a preferred embodiment, the protein of SEQ ID No: 284 or part of thereof is used to obtain reagents, such as antibodies. These reagents could be used in radioimmunoassays, competitive binding assays, Western Blot analysis, enzyme-linked immunosorbant assay (ELISA), immunohistochemisty, or any other technique known to those skilled in the art (Palcic et al. Carbohydr Res 1990;196:133–40). In a preferred embodiment, antibodies raised against the present protein of invention provides tools to specifically visualize salivary or digestive tract tissues (and cells derived from the tissues). This can be useful for various applications, including the determination of the origin or identity of cells, e.g. cancerous cells, as well as to facilitate the identification of particular cells and tissues for, e.g. the evaluation of histological slides. Such assays may also be used for diagnosis in various disorders including, but are not limited to, neoplastic tumors such as salivary, prostate, liver, digestive disease tract and pancreas cancers. Various types of samples can be assayed, including tumor tissues, or other biological samples such as serum or plasma.

The invention further relates to glycosylated compounds, preferably fucosylated compounds, obtained using any of the processes described herein using the protein of the invention or part thereof. Such compounds may be used in the diagnosing, prevention and/or treating of disorders including, but are not limited to, cancer, cystic fibrosis, ulcer, inflammation and immune based disorders, including autoimmune disorders such as arthritis, fertility disorders, and hypothyroidism. These conditions include infectious diseases where active infection exists at any body site, such as meningitis and salpingitis; complications of infections including septic shock, disseminated intravascular coagulation, and/or adult respiratory distress syndrome; acute or chronic inflammation due to antigen, antibody and/or complement deposition; inflammatory conditions including arthritis, cholangitis, colitis, encephalitis, endocarditis, glomerulonephritis, hepatitis, myocarditis, pancreatitis, pericarditis, reperfusion injury and vasculitis. Immune-based diseases include but are not limited to conditions involving T-cells and/or macrophages such as acute and delayed hypersensitivity, graft rejection, and graft-versus-host disease; auto-immune diseases including type I diabetes mellitus and multiple sclerosis. In a preferred embodiment, these glycosylated compounds or derivatives thereof may be used as pharmacological agents to trap pathogens or endogenous ligands thus reducing the binding of pathogens or endogenous ligands to the endogenous glycosylated compounds. For example, such compounds may be used to prevent and/or inhibit the adhesion of cancer cells to inner wall of blood vessel or aggregation between cancer cells and platelets, thus reducing cancer metastasis, to prevent and/or inhibit the adhesion of neutrophils to blood vessels endothelial cells. Other disorders include infections in which recognition of a glycosylated product is essential to the development of the infection. Such infections include, but are not limited to those caused by *Helicobacter pylori, E. coli* and viruses such as HIV. In a preferred embodiment, such compounds, preferably oligosaccharides, are used as gram positive antibiotics and disinfectants (U.S. Pat. Nos. 4,851,338 and 4,665,060).

The invention further relates to methods and compositions using the protein of the invention or part thereof for diagnosis, prevention and/or treatment of several disorders in which recognition of glycosylated compounds, preferably of fucosylated compounds, is impaired or needs to be impaired. For diagnostic purposes, the expression of the protein of the invention could be investigated using any of the Northern blotting, RT-PCR or immunoblotting methods described herein and compared to the expression in control individuals. For prevention and/or treatment purposes, inhibiting the endogenous expression of the protein of the invention may be used to reduce the production of glycosylated compounds detrimental to the organism using any of the antisense or triple helix methods described herein as well as antagonists of the protein's activity.

In another embodiment, various substances can be used for treatment, attenuation and/or prevention for treatment of abnormal conditions associated to unbalanced amounts and/or activity of the protein of SEQ ID No. 284. Such substances include, but are not limited to, chemical compounds such as agonists and antagonists, nucleic acids, and antibodies. In particular, the protein of the invention or part thereof may be used in the development of inhibitors of glycosyl transferase, more particularly inhibitors of fucosyltransferases, for mechanistic and clinical applications (Taylor, Curr Opin Struc Biol 1996; 6:830–7; Colman, Pure Appl Chem 1995; 67:1683–8; Bamford, Enz Inhib 1995; 10:1–16; Khan & Matta, In Glycoconjugates, Composition, Structure, and Function. pp361–378. eds., Allen, H. J. & Kisailus, E. C. Marcel Dekker, Inc. New York, 1992; Thorne-Tjomsland et al., Transplantation 2000; 69:806–8; Basset et al., Scand J Immunol 2000; 51:307–11). Such substances may be employed for treatment of a variety of therapeutic and prophylactic purposes including certain types of neoplastic disorders. For instance, substances targeted against the protein of SEQ ID No. 284 can be administered to treat patients affected with, but not limited to, salivary, prostate, liver, digestive disease tract and pancreas cancers. Alternatively, such substances can be used for treatment, attenuation and/or prevention of infectious disease in order to induce resistance of various microorganisms agents.

Protein of SEQ ID NO:292 (Internal Designation 181-10-1-0-D10-CS)

The protein of SEQ ID NO:292 is encoded by the cDNA of SEQ ID NO:51. Accordingly, it will be appreciated that all characteristics and uses of the polypeptide of SEQ ID NO:292 described throughout the present application also pertain to the polypeptide encoded by a nucleic acid included in clone 181-10-1-0-D10-CS. In addition, it will be appreciated that all characteristics and uses of the nucleic acid of SEQ ID NO:51 described throughout the present application also pertain to the nucleic acid included in clone 181-10-1-0-D10-CS.

The protein of SEQ ID NO:292 was identified among the cDNAs from a library constructed from fetal liver. Tissue distribution analysis using databases indicated that mRNA encoding this protein was found primarily in fetal kidney and fetal liver.

The protein of SEQ ID NO:292 is most likely a polymorphic variant (92% identity) of human secreted protein SEQ ID NO: 197 from the protein described in PCT publication WO 9906553-A2, the disclosure of which is incorporated herein by reference in its entirety. Further, the protein of SEQ ID NO:292 is homologous to the C-type lectin domain of mouse macrophage asialoglycoprotein-binding protein (M-ASGP-BP, 36% identity), mouse natural killer (NK) cell surface protein P1 40 (NKR-, P1.9, 34%) and human asialoglycoprotein receptor L-H2 from EP 773289-A2 (27%). Thus, the present invention relates to nucleic acid and amino acid sequences of a lectin-like protein and to the use of these sequences in the diagnosis, study, prevention and treatment of disease.

The protein of SEQ ID NO:292 consists of 111 amino acids. From the amino acid alignments and the hydrophobicity plots, it has a predicted signal peptide sequence spanning residues 12–24 and one predicted transmembrane domain spanning residues 5–25. Accordingly, one embodiment of the present invention is a polypeptide comprising the signal peptide or the transmembrane domain.

A number of different protein families share a conserved domain which was first characterized in some animal lectins and which seems to function as a calcium-dependent carbohydrate-recognition domain (Drickamer K., J. Biol. Chem., 263:9557–9560,1988, the disclosure of which is incorporated herein by reference in its entirety). This domain, which is known as the C-type lectin domain (CTL) or as the carbohydrate-recognition domain (CRD), consists of about 110–130 residues. There are four cysteines that are perfectly conserved and involved in two disulfide bonds. Several categories of proteins can de found in which the CTL domain has been described. Both M-ASGP-BP and NKR-P1 are type II membrane proteins. Type II membrane proteins in which the CTL domain has been located at the C-terminal extremity include: 1) Asialoglycoprotein receptors (ASGPR), also known as hepatic lectins. The ASGPR's mediate the endocytosis of plasma glycoproteins to which the C-terminal sialic acid residue in their carbohydrate moieties has been removed. 2) A number of proteins expressed on the surface of NK cells, and some subsets of T cells: NKG2, NKR-P1, Ly-49, CD69, and on B cells: CD72, LyB-2. The CTL-domain in these proteins is distantly related to other CTL-domains, and it is unclear whether they all bind carbohydrates.

M-ASGP-BP is a lectin-like molecule expressed on the surface of activated macrophages and specific for terminal D-galactose and N-acetyl-D-galactosamine units (Oda S et al., J. Biochem., 104:600–605,1988, the disclosure of which is incorporated herein by reference in its entirety). Experimental results suggest that M-ASGP-BP participates in the interaction between tumoricidal macrophages and tumor cells.

ASGPR is a membrane protein expressed specifically by hepatocytes. Its function is to uptake asialoglycoproteins in the serum for degradation in the liver. Partially deglycosylated plasma glycoproteins are efficiently and specifically removed from the circulation by a receptor-mediated process. In mammals, the ASGPR specific for desialylated (galactosyl-terminal) glycoproteins, is expressed exclusively in hepatic parenchymal cells. Following binding of the ligand to this cell surface receptor, the receptor-ligand complex is internalized and transported by a series of membrane vesicles and tubules to an acidic-sorting organelle where receptor and ligand dissociate (Spiess M et al., J. Biol. Chem., 260:1979–1982, 1985, the disclosure of which is incorporated herein by reference in its entirety). Reduction in expression of AGPR has been reported in response to such liver conditions as hepatic cirrhosis, liver cancer and regenerated liver (Stadalnik et al., J. Nucl. Med., 26:1233–1242, 1985, the disclosure of which is incorporated herein by reference in its entirety). It has also been reported that ASGPR itself is present in serum (Katsugi et al., Alcohol Metabolism and Liver, 12:65–68, 1992, the disclosure of which is incorporated herein by reference in its entirety), which resulted in significant research being pursued toward the measurement of serum ASGPR. Furthermore, published results indicate that labeling compounds binding to ASGPR can be used as good indicators of liver function (Kudo, et al., Japan Assoc. of Gastrointest. Pathology., 89:1349–1359, 1992, the disclosure of which is incorporated herein by reference in its entirety).

NK cells constitute the third major population of lymphocytes. They possess the inherent capacity to kill various tumors and virally infected cells and mediate the rejection of allografts. These properties allow NK cells to have a major role in the regulation of innate immune responses in particular, and immunological functions in general. Members of the NKR-P1 family are type-II transmembrane C-type lectin receptors found on the surface of NK cells and a subset of T lymphocytes (NK T cells). Further, a subset of NKR-P1 molecules has been identified at the surface of peripheral blood monocytes and dendritic cells (Poggi A et al., Eur. J. Immunol., 27: 2965–2970, 1997, the disclosure of which is incorporated herein by reference in its entirety). Deficiencies in NKR-P1$^+$ T cells, which preferentially accumulate in the liver and bone marrow, have been implicated in the susceptibility to many diseases including insulin-dependent diabetes mellitus (IDDM, Tori M et al. Transplantation, 70:32–38, 2000, the disclosure of which is incorporated herein by reference in its entirety) and multiple sclerosis (Poggi A et al., J. Immunol., 162: 4349–4354, 1999, the disclosure of which is incorporated herein by reference in its entirety). NKR-P1 receptors have been shown to activate NK cell cytotoxicity coupled with release of interferon-γ (IFN-γ, Brown M G., Immunol. Rev., 155: 55–75, 1997, the disclosure of which is incorporated herein by reference in its entirety). However, unlike the well-characterized MHC class I ligands that regulate the specificity of the Ly-49 family of molecules, which are structurally related to the NKR-P1 receptors, cognate ligands for the NKR-P1 molecules have yet to be identified. Interestingly, it has been reported that a subset of the NKR-P1 molecules— NKR-P1B—inhibits NK cell activation (Carlyle et al., J. Immunol., 162:5917–5923, 1999, the disclosure of which is incorporated herein by reference in its entirety).

Based on the structural and chemical homologies the protein of SEQ ID NO:292 was characterized as a C-type lectin-like, type II membrane protein, whose ligand binding may be calcium dependent. The protein of SEQ ID NO:292 or fragments thereof may provide the basis for clinical diagnosis of diseases associated with its induction and/or repression. This protein, framents thereof or antagonists/inhibitors thereof may be useful in the diagnosis and treatment of tumors, viral infections, inflammation, or conditions associated with impaired immunity, organ transplantation, bacterial infections, autoimmunity, hepatic dysfunction and liver regeneration. Furthermore, the protein SEQ ID NO: 292 or fragments thereof may be used as a reagent for analyzing the control of gene expression by IFNs and other cytokines such as IL-12 and IL-4, as well as growth and transcription factors, in normal and diseased cells.

The protein of SEQ ID NO:292 has homology to the CTL domains of the ASPRG, M-ASGP-BP and NKR-P1 molecules. The protein of SEQ ID NO:292, in membrane-bound or soluble forms may have cytokine receptor activity, cell proliferation/differentiation activity, T cell activation activity, tissue growth regulating activity, receptor/ligand activity, signal transduction activity, to promote transendothelial migration, anti-inflammatory activity, tumor inhibition activity, among others. Accordingly, the protein SEQ ID NO:292 or fragments thereof may be used in diagnosis and treatment of diseases such as, but not limited to, autoimmune disorders such as autoimmune hepatitis, rheumatoid arthritis, Graves disease, systemic lupus erythematosus, Wegener's granulomatosis, sarcoidosis, polyarthritis, pemphigus, pemphigoid, erythema multiform, Sjogren's syndrome, inflammatory bowel disease, autoimmune encephalitis, myasthenia gravis keratitis, scleritis, Lupus Nephritis, and allergic encephalomyelitis; proliferative disorders including various forms of cancer such as leukemias, lymphomas (Hodgkins and non-Hodgkins), sarcomas, melanomas, adenomas, carcinomas of solid tissue, hypoxic tumors, squamous cell carcinomas of the mouth, throat, larynx, and lung, genitourinary cancers such as cervical and bladder cancer, hematopoietic cancers, head and neck cancers, and nervous system cancers, benign lesions such as papillomas, atherosclerosis, angiogenesis; viral infections, in particular HBV, HCV and HIV infections, as well as other viral- and pathogen-induced infections. The protein of SEQ ID NO:292 or fragments thereof may also be used to treat conditions associated with inflammation or immune impairment (e. g. reumathoid and osteo arthritis and AIDS), allergy, hepatic cirrhosis and liver toxicity; as well as genetic disorders, chronic illnesses and infections associated with decrease in NK, NK T, moacrophage, monocyte and dendritic cell functions. In another embodiment of the invention, inhibitors of the protein of SEQ ID NO:292 may be used to treat conditions such as multiple sclerosis, IDMM, graft versus host disease (GVH) and transplanted organ rejection.

Another embodiment relates to methods to treat and/or prevent the bacterial infections that arise in liver due to bacterial antigens brought from the intestine from the portal vein. In this embodiment, the protein of SEQ ID NO:292 may be used to counteract the effects of the bacterial endotoxin lipopolysaccharide (LPS). Another embodiment of the invention is the use of the protein of SEQ ID NO:292 or fragments thereof to inhibit of NK cells activated by bacterial superantigens or LPS, which would help treat vascular endothelial injury in conditions such as Kwasaki disease.

The appearance of autoantibodies against the protein of SEQ ID NO:292 can be used as an indicator for autoimmune hepatitis (AIH), a disease that can lead to cirrhosis and fatal intractable hepatitis, as well as primary biliary cirrosis. The nucleic acid sequences encoding the protein of SEQ ID NO:292 or fragments thereof can be used for producing secreted forms of the protein. They can also be used to develop products for diagnosis and therapy. Accordingly, recombinant soluble derivatives can be used for detecting and measuring antibodies specific for the protein of the invention, e.g. by ELISA, Western blotting, etc. This allows AIH to be diagnosed and distinguished from other diseases.

In another embodiment of the invention, the protein of SEQ ID NO:292 or fragments or derivatives thereof can also be used for the analysis and purification of asialoglycoproteins and to develop inhibiting agents against asialoglycoprotein incorporation, or viral and other protein invasion, into liver cells.

Another embodiment of the present invention relates to polypeptides comprising the protein of SEQ ID NO:292 or fragments thereof and polynucleotides encoding the protein of SEQ ID NO:292 or fragments thereof. In another aspect the protein of SEQ ID NO:292 or fragments thereof may be used to identify specific molecules with which it binds such as agonists, antagonists or inhibitors. In a further aspect, the invention relates to methods for identifying agonists and antagonists/inhibitors of the protein of SEQ ID NO:292, and treating conditions associated with the protein of the invention or imbalance with the identified compounds. In a still further aspect, the invention relates to diagnostic assays for detecting diseases associated with inappropriate levels or activity of the protein of SEQ ID NO:292. Another embodiment of the invention relates to methods of measuring the amount of the protein of SEQ ID NO:292 in serum. Another embodiment relates to the use of labeling compounds that bind to the protein of SEQ ID NO:292 and can be used as good indicators of liver function or NK cell activity, among others.

An embodiment of the present invention relates to methods of using the protein of the invention or part thereof to identify and/or quantify or other ligands, which may interact with the protein of SEQ ID NO:292. The protein of SEQ ID NO:292 or fragments thereof may be include in pharmaceutical preparations for treating cancer or prevention/treatment of other diseases associated with changes in expression of the protein of the invention (see above). In a preferred embodiment of the invention the protein of the invention or part thereof is used to modulate the effect of cytokines and related molecule such as IL-1, IL-2, IL-12, IFN-γ. The protein of SEQ ID NO:292 may also be used to correct defects in vivo models of disease such as autoimmune, inflammation, pathogen-mediated infection, liver toxicity, allograft rejection, GVH, as well as tumor models, by injecting the protein either intraperitoneally, intravenously, subcutaneously or directly in the diseased tissue.

The DNA encoding the protein of SEQ ID NO:292 or fragments thereof may be used in diagnostic assays for conditions/diseases associated with up-regulation or down-regulation of the expression of the protein of the invention (see above). The diagnostic assay is useful to distinguish between absence, presence, and excess expression of the protein and to monitor regulation of levels of the protein of during therapeutic intervention. The DNA may also be incorporated into effective eukaryotic expression vectors and directly targeted to a specific tissue, organ, or cell population for use in gene therapy to treat the above mentioned conditions, including tumors and/or to correct disease- or genetic-induced defects in any of the above mentioned proteins including the protein of the invention. The DNA may also be used to design antisense sequences and ribozymes, which can be administered to modify gene expression in NK, NK T, macrophages, monocytes and dendritic cells and to influence expression of cytokines such as IL-1, IL-2, IL-4, IL-12, and IFN-γ. In vivo delivery of genetic constructs into subjects can be developed to the point of targeting specific cell types, such as tumor where expression of the protein of SEQ ID NO:292 may be affected or is modulating the expression and/or activity of other proteins such as cytokines, growth factors, their receptors and/or tumor antigens. The DNA may also be used to identify unknown upstream sequences (e. g. promoters and regulatory elements) by standard techniques and for research into the control of gene expression by IFNs and other cytokines, as well as growth and transcription factors in normal and diseased cells. Hybridization probes are useful to detect DNA encoding the protein of SEQ ID NO:292 (or closely related molecules) in biological samples, and for mapping the naturally occurring genomic sequence to a particular chromosome/chromosome region. The DNA may be used to generate and/or treat in vivo animal models of disease, including susceptibility or resistance to infection, tumors, autoimmune conditions, GVH, allograft rejection and liver toxicity, based on vaccine, knock-out and transgene technologies.

Antibodies against the protein of SEQ ID NO:292 are useful for the diagnosis of conditions and disease associated with its expression and to quantify the protein of the invention (e. g. in assays to monitor patients during therapeutic intervention). Antibodies specific for the protein may include, but are not limited to, polyclonal, monoclonal, chimeric, single chain, Fab fragments produced by a Fab expression library. Neutralizing antibodies are especially preferred for diagnostics and therapeutics. Diagnostic assays for the protein of the invention include methods utilizing the antibody and a label to detect the protein of SEQ ID NO:292 in human body fluids or extracts of cells or tissues as well as methods for detecting or measuring antibodies against the protein of SEQ ID NO:292.

The protein of SEQ ID NO:292 and its catalytic or immunogenic fragments or oligopeptides thereof, can be used for screening therapeutic compounds in any variety of drug screening techniques including high throughput. Methods which may be used to quantitate the expression of the nucleotide or protein of the invention include, but are not limited to, polymerase chain reaction (PCR), RT-PCR, RNAse protection, Northern blotting, enzyme-linked immunosorbent asay (ELISA), radioimmunoassay (RIA), fluorescent activated cell sorting (FACS), immunoprecipitation, and chromatography.

Accordingly, the protein of SEQ ID NO:292 or fragments thereof may be used to purify or enrich proteins containing carbohydrates. In such embodiments, the lectin of the present invention is placed in contact with carbohydrate-containing proteins under conditions which facilitate specific binding. The lectin of the present invention may be fixed to a solid support. After binding, specifically bound proteins are dissociated using appropriate salt or other conditions.

The protein of SEQ ID NO:292 or fragments thereof may also be used to regulate any of the activities described above, including the interaction between tumoricidal macrophages and tumor cells, the activity of NK cells, the treatment of bacterial infections resulting from bacterial antigens brought from the intestine, or to counteract the effects of bacterial LPS.

Accordingly, the present invention includes the use of the protein of SEQ ID NO:292 fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition in an individual. For example, the condition may be any of those described above or an abnormality in any of the functions listed above. In such embodiments, the protein of SEQ ID NO:292, or a fragment thereof, is administered to an individual in whom it is desired to increase or decrease any of the activities of the protein of SEQ ID NO:292. The protein of SEQ ID NO:292 or fragment thereof may be administered directly to the individual or, alternatively, a nucleic acid encoding the protein of SEQ ID NO:292 or a fragment thereof may be administered to the individual. Alternatively, an agent which increases the activity of the protein of SEQ ID NO:292 may be administered to the individual. Such agents may be identified by contacting the protein of SEQ ID NO:292 or a cell or preparation containing the protein of SEQ ID NO:292 with a test agent and assaying whether the test agent increases the activity of the protein. For example, the test agent may be a chemical compound or a polypeptide or peptide.

Alternatively, the activity of the protein of SEQ ID NO:292 may be decreased by administering an agent which interferes with such activity to an individual. Agents which interfere with the activity of the protein of SEQ ID NO:292 may be identified by contacting the protein of SEQ ID NO:292 or a cell or preparation containing the protein of SEQ ID NO:292 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify the source of a sample as, for example, fetal liver or fetal kidney, or to distinguish between two or more possible sources of a sample on the basis of the level of the protein of SEQ ID NO:292 in the sample. For example, the protein of SEQ ID NO:292 or fragments thereof may be used to generate antibodies using any techniques known to those skilled in the art, including those described therein. Such antibodies may then be used to identify tissues of unknown origin, for example, forensic samples, differentiated tumor tissue that has metastasized to foreign bodily sites, or to differentiate different tissue types in a tissue cross-section using immunochemistry. In such methods a sample is contacted with the antibody, which may be detectably labeled, under conditions which facilitate antibody binding. The level of antibody binding to the test sample is measured and compared to the level of binding to control cells from fetal liver or fetal kidney or tissues other than fetal liver or fetal kidney to determine whether the test sample is from fetal liver or fetal kidney. Alternatively, the level of the protein of SEQ ID NO:292 in a test sample may be measured by determining the level of RNA encoding the protein of SEQ ID NO:292 in the test sample. RNA levels may be measured using nucleic acid arrays or using techniques such as in situ hybridization, Northern blots, dot blots or other techniques familiar to those skilled in the art. If desired, an amplification reaction, such as a PCR reaction, may be performed on the nucleic acid sample prior to analysis. The level of RNA in the test sample is compared to RNA levels in control cells from fetal liver or fetal kidney or tissues other than fetal liver or fetal kidney to determine whether the test sample is from fetal liver or fetal kidney.

In another embodiment, antibodies to the protein of the invention or part thereof may be used for detection, enrichment, or purification of cells expressing the protein of SEQ ID NO:292, including using methods known to those skilled in the art. For example, an antibody against the protein of SEQ ID NO:292 or a fragment thereof may be fixed to a solid support, such as a chromatography matrix. A preparation containing cells expressing the protein of SEQ ID NO:292 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:292 or a fragment thereof thereof may be used to diagnose disorders associated with altered expression of the protein of SEQ ID NO:292. In such techniques, the level of the protein of SEQ ID NO:292 in an ill individual is measured using techniques such as those described herein. The level of the protein of SEQ ID NO:292 in the ill individual is compared to the level in normal individuals to determine whether the individual has a level of the protein of SEQ ID NO: 292 which is associated with disease.

Protein of SEQ ID NO: 408 (Internal Designation 179-14-2-0-F11-CS

The 236 amino acid protein of SEQ ID NO: 409, herein referred to as PNMT A, and encoded by the cDNA of SEQ ID NO: 168 is found in fetal kidney and fetal brain. PNMT A is a polymorphic variant of human phosphotidylethanolamine N-methyltransferase (PNMT) (SPTREMBLNEW SPTREMBL SWISSPROT accession number Q9UHY6). PNMT A differs from the sequence of PNMT (STR accession number Q9UHY6) by two amino residues. Position 95 contains an isoleucine residue (I) substituted for a valine residue (V); position 130 contains a valine residue (V) substituted for a glutamine residue (G). PNMT A displays 4 candidate membrane-spanning segments in positions 50 to 70, 83 to 103, 131 to 151 and 196 to 216.

Catecholamine neurotransmitters [e.g., dopamine, noradrenaline (norepinephrine), adrenaline (epinephrine)] are synthesized in catecholaminergic neurons from tyrosine, via dopa, dopamine and noradrenaline, to adrenaline. Four enzymes are involved in the biosynthesis of adrenaline: (1) tyrosine 3-mono-oxygenase (tyrosine hydroxylase, TH); (2) aromatic L-amino acid decarboxylase (AADC, or Dopa decarboxylase, DCC); (3) dopamine beta-mono-oxygenase (dopamine beta-hydroxylase, DBH); and (4) noradrenaline N-methyltransferase (phenylethanolamine N-methyltransferase, PNMT)(Nagatsu, Neurosci. Res. 12:315–345 (1991)). PNMT, the final enzyme in the pathway for adrenaline biosynthesis catalyses the production of adrenaline from noradrenaline using S-adenosyl-L-methionine as a methyl donor. For this reason, PNMT serves as a good marker for tissues and cells producing epinephrine (adrenaline). Studies conducted by Kennedy and collaborators have shown that PNMT are widely distributed in human tissues including heart and kidney (Kennedy et al., J. Clin. Invest. 95:2896–2902 (1995)).

In some pheochromocytomas, the tumors contain and secrete greater amounts of adrenaline than do normal adrenal medullas. In a case/control study, Isobe et al. have shown that adrenaline-secreting pheochromocytomas express significantly greater amounts of PNMT mRNA than do normal adrenal medullas (Isobe et al. J. Urol. 163:357–362 (2000)). Moreover, PNMT immunoreactivity is only detected in the adrenaline-secreting tumors. The C-1 region in the rostral ventral lateral medulla contains mainly adrenaline neurons. These neurons are the tonic vasomotor center of the brain. Burke et al. have demonstrated changes in the enzymatic activity of PNMT in axon terminals and cell bodies of neurons from the medulla of patients with Alzheimer's disease. They have also shown that PNMT protein is decreased in axon terminals in brains from patients with Alzheimer's disease; the decrease in PNMT appears to be due to retrograde degeneration of epinephrine neurons (Burke et al., Ann. Neurol. 22:278–280 (1987)). In the case of advanced Alzheimer's disease, the Burke et al. presented evidence that the accumulation of PNMT in the perikarya results from diminished transport of this enzyme to axon terminals (Burke et al., J. Am. Geriatr. Soc. 38:1275–1282 (1990)).

Neurons that contain PNMT have cell bodies in brain stem regions of the rat brain and send projections mainly into other brain stem areas, such as the hypothalamus and the spinal cord. These neurons can be affected pharmacologically by various kinds of drugs. PNMT inhibitors currently represent the only means of modifying adrenaline neurons pharmacologically without affecting noradrenaline or dopamine neurons in brain. Experiments conducted in deoxycorticosterone acetate-salt (DOCA-salt) hypertensive rats and spontaneously hypertensive rats (SHR) have shown that inhibitors of PNMT lower blood pressure (Goldstein et al., Life Sci. 30:1951–1957 (1982); Lyang et al., Res. Commun. Chem. Pathol. Pharmacol. 46:319–329 (1984); Chatelain et al., J. Pharmacol. Exp. Ther. 252:117–125 (1990)). Molecules and compounds affecting adrenaline neurons may also be of use in the treatment of psychiatric disorders and neuroendocrine dysfunction.

One embodiment of the subject invention provides polypeptides comprising the sequence of PNMT A. Other polypeptides of the invention include polypeptides comprising the amino acids of SEQ ID NO: 409 from positions 50 to 70, 83 to 103, 131 to 151 and/or 196 to 216. Also encompassed by the instant invention are biologically active fragments of the PNMT A protein. "Biologically active fragments" are defined as those peptide or polypeptide fragments of PNMT A which have at least one of the biological functions of the PNMT A protein (e.g., the ability to catalyze the formation of adrenaline). In a preferred embodiment, the biologically active fragment of PNMT A contains at least one of the amino acid substitutions which distinguish PNMT A from PNMT (i.e., an isoleucine residue (I) substituted for a valine residue (V) at position 95; and/or valine residue (V) substituted for a glutamine residue (G) at position 130). In one embodiment, the PNMT A polypeptides of the invention are encoded by clone 179-1462-0-F11-CS.

Thus, one embodiment of the invention provides an enzymatic component of the adrenaline synthetic pathway and methods of producing adrenaline in accordance with methods known to those skilled in the art. These methods substitute PNMT A, or biologically active fragments thereof, for the PNMT enzyme used in these known synthetic pathways.

The invention also provides variants of the protein of SEQ ID NO: 409. These variants have at least about 80%, more preferably at least about 90%, and most preferably at least about 95% amino acid sequence identity to the amino acid sequence of PNMT A. Variants according to the subject invention also have at least one functional or structural characteristic of PNMT A, such as the ability to catalyze the formation of adrenaline. The invention also provides biologically active fragments of the variant proteins. Unless otherwise indicated, the methods disclosed herein may be practiced utilizing PNMT A or variants thereof. Likewise, the methods of the subject invention may be practiced using biologically fragments of PNMT A, or variants thereof, provides that said biologically active fragments contain the amino acid substitutions noted supra.

One embodiment of the subject invention provides methods of using the protein of the invention, or biologically active fragments thereof, to label (chemically or isotopically) the adrenaline molecule in vitro. The labeled adrenaline molecules can then be used to localize receptors in tissue cuts by in situ hybridization experiments.

The invention also provides a fusion protein or polypeptide in which PNMT A, or biologically active fragments thereof, are combined with another protein (tag) by the use of a recombinant DNA molecule. The resulting purified, and enzymatically active fusion product, is then added, in vitro, to the noradrenaline precursor and to S-adenosyl-L-methionine as a methyl donor. The enzymatic reaction is then performed in conditions known to those skilled in the art (Burke et al., Proc. Soc. Exp. Biol. Med. 181:66–70 (1986); Morimoto et al., Endocr. J. 40:179–183 (1993)). In this reaction, the methyl group of S-adenosyl-L-methionine must be labeled isotopically ([14C]-S-adenosyl-L-methionine or [methyl-3H]-S-adenosylmethionine), or chemically, in order to allow the transfer of a "tagged" methyl group to the adrenaline molecule.

Similarly, in cells transfected with cDNAs encoding the protein of the invention PNMT activity of expressed proteins may be measured by incubating cytosolic fractions with [14C]-S-adenosyl-L-methionine and normetanephrine for 60 min according to methods described by those skilled in the art (Morimoto et al., ibid.). Agonists and/or antagonists of PNMT activity may also be tested (high throughput screening) on transfected cells expressing the wild type form of the protein of the invention. Again, effects of such drugs on PNMT enzymatic activity is measured by the methods described above.

The invention further relates to methods and compositions used to modify the protein of the invention (i.e. derivatize the PNMT A protein). Post-translational modifications encompassed by the invention include, N-linked or O-linked carbohydrate chains, processing of N-terminal or C-terminal ends, attachment of chemical moieties, such as polyethylene glycol, to the amino acid backbone, chemical modifications of N-linked or O-linked carbohydrate chains, and addition or deletion of an N-terminal methionine residue as a result of prokaryotic host cell expression. Some of these modifications of the protein of the invention may facilitate its extraction and purification in prokaryotic expression systems. Post-translational modifications such as N-linked or O-linked carbohydrate chains addition may also optimize the enzymatic activity of the protein of the invention when it is first produced in a prokaryotic system.

Another embodiment of the subject invention provides antibodies directed against the protein of the invention or immunogenic fragments thereof. The antibodies of the invention are useful for the screening of tissues and cells producing adrenaline or for affinity purification of PNMT or PNMT A. These antibodies may also be used in the diagnosis of pathologies and disorders such as pheochromocytomas and Alzheimer's disease, where PNMT A is overexpressed. Methods of peforming affinity purification as well as methods of making polyclonal and monoclonal antibodies are well known to those skilled in the art.

In therapeutic regimens, neutralizing antibodies may be used as antagonists of PNMT A and used to treat conditions associated with overexpression of PNMT A. These disorders include, and are not limited to, hypertension, pheochromocytomas, and advanced Alzheimer's disease (Goldstein et al., Life Sci. 30:1951–1957 (1982); Lyang et al., Res. Commun. Chem. Pathol. Pharmacol. 46:319–329 (1984); Chatelain et al., J. Pharmacol. Exp. Ther. 252:117–125 (1990); Isobe et al., J. Urol. 163:357–362 (2000); Burke et al., J. Am. Geriatr. Soc. 38:1275–1282 (1990)).

Proteins of SEQ ID NOs: 395 and 403 (Internal Designation: 160-01-3-0-H2-CS and 160-99-4-0-E4-CS Respectively The 367-amino-acid-long proteins of SEQ ID NOs: 395 and 403 encoded by the cDNAs of SEQ ID NOs: 154 and 162 respectively are polymorphic variants, the first one being overexpressed in fetal brain and ovary and the second one in fetal brain only. They both contain glutathione S-transferase (GST) domains from positions 47 to 122, and 206 to 309 which are respectively the G-site and H-site described below. In addition, they also display two hydrophobic domains (from aa 258 to aa 278 and from aa 338 to aa 358) which are characteristic of some GST proteins.

Glutathione S-transferase proteins (GSTs) are dimeric proteins that catalyse the conjugation of glutathione to a wide range of hydrophobic compounds (through the formation of a thioether bond with their electrophilic centre) to create the products which are less reactive, more hydrophilic, and thus more easily excreted from the cells. The GST superfamily (E.C. 2.5.1.18) is indeed believed to be one of the most important proteins in the detoxification of reactive electrophiles within living cells. Glutathione is a cellular tripeptide (gamma-glutamylcysteinylglycine) which is perhaps the most abundant amino acid derivative contained in the cells of higher life forms. The middle amino acid in glutathione, cysteine, has a free thiol group which can compete with the nucleophilic site on nucleotide bases for reaction with electrophiles. Within the cell, glutathione functions so as to conjugate to xenobiotic toxic molecules in general, and electrophiles in particular, to render the toxic molecules less reactive against cellular macromolecules and to target the toxic molecules for subsequent metabolic and excretion pathways.

Based on amino acid sequence identity, there are at least seven major classes of GST proteins (designated alpha, kappa, mu, pi, sigma, theta and zeta). Sequence similarity between classes is rather low, ranging between 20–30%. However, a single point mutation in the H-subsite region of GST is enough to shift substrate specificity from class pi to alpha (Nuccetelli M. N. et al. Biochem.Biophys.Res.Commun. 252: 184–189 (1998)). In spite of relatively low sequence identity, the GSTs exhibit a high degree of structural similarity. It is generally known that the GST molecule binds quite specifically and with high affinity to glutathione, but binds promiscuously to a wide variety of xenobiotic, electrophilic, and alkylating chemical agents. All GST enzymes of the four main cytosolic classes is found in dimeric form with two active sites per dimer each of which functions independently of the other. The active site has been characterized as consisting of a glutathione binding region (designated the G-site) and a non-specific hydrophobic binding region (designated the H-site) to accommodate the electrophilic substances. Pi-, mu-, alpha- and theta-class crystal structures have been elucidated; all possess a similar GSH-binding site, but the hydrophobic substrate-binding site (H-subsite) is subject to variation across the classes (Allardyce C. S. et al. Biochem.J. 343 525–531 (1999)). The GST activity has been suggested be involved in the regulation of the assembly of multisubunit complexes by shifting the balance between glutathione, disulfide glutathione, thiol groups of cysteines, and protein disulfide bonds. The GST domain is a widespread, conserved enzymatic module that may be covalently or noncovalently complexed with other proteins. Regulation of protein assembly and folding may be one of the functions of GST (Koonin EV et al. Protein Sci 3:2045–2054 (1994)).

The cytosolic glutathione S-transferase are known to belong to four classes, designated Alpha, Mu, Pi and Theta. A fifth class of glutathione S-transferases is a microsomal enzyme found primarily in liver endoplasmic reticulum. An extensive analysis of the expression microsomal glutathione transferase 1 in human tissues shows that it predominantly occurs in liver and pancreas. The relative expression levels in man ranged from: liver and pancreas to kidney, prostate, colon (30–40%), heart, brain, lung, testis, ovary, small intestine (10–20%), placenta, skeletal muscle, spleen, thymus and peripheral blood leucocytes (1–10%). Liver-enriched expression was detected in human fetal tissues with lung and kidney displaying lower levels (10–20%). No transcripts could be detected in fetal brain or heart (Estonius M et al. Eur J Biochem 260:409–13 (1999)). Based on these observations, and the fact that the enzyme is encoded by a highly conserved single-copy gene, it is suggested that microsomal glutathione transferase 1 performs essential functions vital to most mammalian cell types. One particular glutathione S-transferase was still identified in mitochondrial matrix (Pemble S. E. et al. Biochem.J. 319: 749–754 (1996)).

GST and GST-like proteins are largely spread in organisms. In vertebrates and in cephalopodes some proteins (christallins) presented in the lenses are structurally related to alpha-class GSTs (Chiou S. H. et al. Biochem.J. 309: 793–800 (1995)). Furthermore, the olfactory epithelial cytosol shows the highest GST activity among the extrahepatic tissues. The olfactory GSTs were found to catalyse glutathione conjugation of several odorant classes, including many unsaturated aldehydes and ketones, as well as epoxides and were proposed to play an important role in chemoreception (Ben-Arie N. et al. Biochem.J. 292: 379–384 (1993)).

Higher cells each contain a family of many GST isozymes in each class with broad, yet overlapping, specificity. Mu-class GSTs are thought to be involved in the detoxification of reactive oxygen species (cyclised o-quinones) produced via oxidative metabolism of catecholamines. These toxins are thought to be involved in neurological disorders of the nigrostriatal and mesolimbic systems (Parkinsons and Schizophrenia, respectively). Enzymes of the mu-class GSTs are expressed in the substantia nigra and have preferential substrate specificity for the cyclised o-quinones formed by catecholamine metabolism (Hansson L. O. et al. J.Mol.Biol. 287: 265–276 (1999), Takahashi Y. et al. J. Biol. Chem.268: 8893–8 (1993)). Whilst most of the GSTs share common substrates, there are distinct differences in substrate preference between subfamilies. These enzymes have evolved as a cellular protection system against a wide variety of electrophilic compounds, including a range of xenobiotics, oxidative metabolism by-products (oxidized lipid, DNA and catechols), and in particular are known to metabolise a number of environmental carcinogens.

GSTs are also known to catalyze other reactions, such as peroxidase and isomerase reactions (Edwards R. et al. Trends in Plant Sci. 5: 193–198 (2000)) as well as the addition of aliphatic epoxides and arene oxides to glutathione; the reduction of polyol nitrate by glutathione to polyol and nitrite; certain isomerization reactions and disulfide interchange. As well, there are marked species differences in catalytic activities between various purified mammalian hepatic GST mixtures. Some of them catalyse chemical stereospecific conversion of several pharmacological substances much less effective then anothers. For exemple, recombinant human GST was succesfully used in the reaction of steric conversion of 13-cis-retinoic acid to all-trans-retinoic acid (Chen H. and Juchau M. R. Biochem.J. 336: 223–226 (1998)).

An increasing number of GST genes are being recognized as polymorphic. Certain alleles, particularly those that confer impaired catalytic activity may be associated with increased sensitivity to toxic compounds. Genetic polymorphisms and differences in GST expression have been implicated in individual susceptibility to certain types of cancer (for rev. Hayes J D and Strange R C Pharmacology 61:154–166 (2000). For exemple, GSTM1 deficiency predisposes to head and neck cancer, especially to cancer of the larynx, which is particularly exposed to tobacco smoke carcinogens (Gronau S et al. Laryngorhinootologie 79:341–344 (2000)). Conversely, over-expression of GSTs is thought to be involved in the phenomenon of multi-drug resistance to cancer chemotherapy. One of the class of electrophilic compounds that are substrates for the glutathione S-transferase enzymes is the group of alkylating agents used in antineoplastic therapy. A common problem that is observed in modem cancer chemotherapy is the appearance of chemotherapeutic resistant tumor cells that, because of the resistivity, no longer respond appropriately to the antineoplastic agents. This resistance is often observed with many drugs that have no physical or mechanistic similarities to the original agent. GST isoenzymes have been shown to be involved in the development of drug resistance to a variety of chemotherapeutic agents such as adriamycin, vinblastine, actinomycin D and colchicine (Beckett, et al. Adv. Clin. Chem. 30:281–380 (1993)). It has been demonstrated that a resistant population of malignant cells shows a modified pattern of total glutathione S-transferase activity. A resistant population of MCF-7 breast cancer cells, identified through selection in adriamycin by Batist et al., J. Biol. Chem., 261:15544–15549 (1986) resulted in a subset of cells which were approximately 200 fold more resistant than the parental cells. The resistant cells were found to exhibit a 45 fold increase in total glutathione S-transferase activity, the increase being due to the result of an appearance of an isozyme not expressed in the parental cell line. It was demonstrated that an increase in glutathione S-transferase alone, an increase conditioned by the transformation of susceptible cells with a foreign DNA construct expressing the wild-type glutathione S-transferase coding region, could increase the resistance of cells to an antineoplastic agent. As reported in Puchalski and Fahl, Proc. Natl. Acad. Sci. USA, 87:2443–2447 (1990), expression of the rat 1-1, 3-3 and the human P1-1 isozymes of glutathione S-transferase in COS cells increased their resistance to the agent. The recent study of increase in resistance of tumor cells to cytotoxic drugs or ionizing radiation has allowed to identify using differential display a new GST-related protein p28 expressed exclusively in lymphoma cell (Kodym R. et al. J. Biol.Chem. 274: 511–5137 (1999)). Subcellular protein fractionation revealed p28 localization in the cytoplasm, but with thermal stress p28 relocated to the nuclear fraction of cellular proteins. The sequence homology and the similar functional characteristics of p28 to other GST family members (in particular relocalization in response to thermal stress and ability to bind glutathione), argues that p28 is a new mammalian member of GST superfamily.

Evidence suggests that the level of expression of GSTs is a crucial factor in determining the sensitivity of cells to a broad spectrum of toxic chemicals. In humans, marked interindividual differences exist in the expression of class alpha, mu and theta GST. For the most abundant mammalian classes of GST the mechanisms of transcriptional and post-translational regulation have been studied. The biological control of alpha-, mu- and pi-classes exhibit sex-, age-, tissue-, species-, and tumor-specific patterns of expression. In addition, GST are regulated by a structurally diverse range of xenobiotics and, to date, more then 100 chemicals have been identified that induce GST (Hayes J. D. and Pulford D. J. Crit.Rev.Biochem.Mol.Biol. 30: 445–600 (1995)). A significant number of these chemicals occur naturally and, as they are found as nonnutrient components in vegetables and citrus fruits, it is apparent that humans are likely to be exposed regularly to such compounds. Many inducers effect transcriptional activation of GST genes through either the antioxidant-responsive element (ARE), the xenobiotic element (XRE), the GST P enhancer 1 (GPE), or the glucocorticoid-responsive element (GRE). Many of compounds that induce GST are themselves substrates for these enzymes, or are metabolized (by cytochrome P-450 monooxygenases) to compounds that can serve as GST substrates, suggesting that GST induction represent part of an adaptive response mechanism to chemical stress by electrophiles. It also appear probable that GST are regulated in vivo by reactive oxygen species, the potents inducers capable of generating free radicals by redox-cycling; such relulation can be an adaptive response to oxydative stress in the cell. It has been shown GST-pi can potently and selectively inhibit activation of jun protein by its upstream kinase (JNK); these results suggest GST-pi can also be a regulator of signal transduction (Monaco R. et al. J.Prot.Chem. 18: 859–866 (1999)). The majority of human tumors express significant amounts of class pi GST (Hayes&Pulford, supra).

Therefore, GSTs have medical importance due to their role in mediating drug resistance in cancer patients. The measurement of GST isoenzymes in vitro has importance in diagnostic medicine. For example, the measurement of the pi isoenzyme of GST in tissue specimens is useful in pathology for the detection and diagnosis of a variety of different tumors. In addition, measurement of the alpha form of GST in blood is useful for the detection and monitoring of a variety of different forms of liver disease (for a detailed description of the clinical applications of GST measurements see Beckett, et al., supra).

It is believed that the proteins of SEQ ID NOs: 395 and 403 or part thereof are transferases, probably transferring alkyl or acyl groups different from methyl group, more probably glutathione S-transferases and, as such, play a role in cellular detoxification especially against xenobiotics and oxidative metabolism byproducts. Preferred polypeptides of the invention are polypeptides comprising the amino acids of SEQ ID NOs: 395 and 403 from positions 47 to 122, and 260 to 309. Other preferred polypeptides of the invention are fragments of SEQ ID NOs: 395 and 403 having any of the biological activities described herein. The transferase activity of the proteins of the invention or part thereof may be assayed using any of the assays known to those skilled in the art including those described for GST proteins as in U.S. Pat.

Nos. 5,866,792 and 6,096,504, which disclosures are hereby incorporated by reference in their entireties.

To find substrates, the proteins of the invention, or part thereof, or derivative thereof, may be used for screening libraries of compounds in any of a variety of drug screening techniques. The fragment employed in such screening may be free in solution, affixed to a solid support, borne on a cell surface, or located intracellularly. The formation of binding complexes, between the proteins of the invention, or part thereof, or derivative thereof, and the agent being tested, may be measured. Antagonists or inhibitors of the proteins of the invention may be produced using methods which are generally known in the art, including the screening of libraries of pharmaceutical agents to identify those which specifically bind the protein of the invention. Another technique for drug screening which may be used provides for high throughput screening of compounds having suitable binding affinity to the proteins of the invention as described in published PCT application WO84/03564.

The invention relates to methods and compositions using the proteins of the invention or part thereof or derivative thereof to catalyze GST-dependent detoxification reactions in vitro or in vivo using any methods known to those skilled in the art. For example, uses of the proteins of the invention or part thereof may be very useful to treat toxic byproducts such as the ones obtained in laboratory experiments, such as dietary toxins due to the use of pesticides on plants used to feed animals or humans, etc. Preferably, the proteins of the invention or part thereof or derivative thereof is added to a sample containing the substrate(s) in conditions allowing detoxyfication, and allowed to catalyze the detoxification of the substrate(s). In a preferred embodiment, the detoxification is carried out using a standard assay such as those described herein.

In some of the above-cited embodiments, compositions comprising the proteins of the present invention or part thereof are added to samples as a "cocktail" with other detoxifying enzymes. The advantage of using a cocktail of detoxifying enzymes is that one is able to detoxify a wide range of substrates without knowing the specificity of any of the enzymes. Using a cocktail of detoxifying enzymes also protects a sample from a wide range of future unknown toxic compounds from a vast number of sources. For example, the proteins of the invention or part thereof is added to samples where toxic compounds are undesirable. Alternatively, the protein of the invention or part thereof may be bound to a chromatographic support, either alone or in combination with other detoxifying enzymes, using techniques well known in the art, to form an affinity chromatography column. A sample containing the undesirable substrate is run through the column to remove the substrate. Immobilizing the proteins of the invention or part thereof on a support is particularly advantageous for those embodiments in which the method is to be practiced on a commercial scale. This immobilization facilitates the removal of the enzyme from the batch of product and subsequent reuse of the enzyme. Immobilization of the protein of the invention or part thereof can be accomplished, for example, by inserting a cellulose-binding domain in the protein. One of skill in the art will understand that other methods of immobilization could also be used and are described in the available literature. Alternatively, the same methods may be used to identify new substrates.

In a preferred embodiment, the invention relates to cells and plants or animals genetically engineered to express the protein of the invention or part thereof, preferably at a high level using any method known to those skilled in the art. Such engineered cells, animals or plants will display enhances detoxification of compounds. In a more preferred embodiment, expression of the proteins of the invention or part thereof will confer resistance to herbicides to transgenic plants using techniques similar to those described in the U.S. Pat. No. 5,866,792.

For such embodiments, the proteins of the invention may need to be modified to enhance their ability to react with specific substrates. These modifications can provide novel isoforms which are specifically efficient against selected electrophilic or alkylating agents. Artificial DNA constructs encoding and expressing such modified or mutant proteins of the invention or part thereof may be selectively delivered into targeted cells to enhance the resistivity of those cells to the alkylating or neoplastic agents. The methods related to such modifications are described (Fahl, et al. U.S. Pat. No. 6,136,605 Oct. 24, 2000). The method is based on random mutation and selection with the selection being performed with the agent against which enhanced activity is sought. The mutation is preferably site directed to the amino acids associated with the H-site on the enzyme, so as to favor the creation of new, useful isoforms of the enzyme.

In another embodiment, the invention relates to compositions and methods using the proteins of the invention or part thereof to design specific systems of artificial chemoreception as described in Ben-Arie N. et al, supra. Such chemoreception systems could recognize odorants, xenobiotics, pesticides, drugs and may be useful for chemical, cosmetic, pharmaceutical, forensic and any other analytical purposes. The design of such a system may be generally based on the subtle specificity of recognition of compounds by different GST isoenzymes. The methods to produce analytical diagnostics based on enzyme specificity are known by those skilled in the art.

In another embodiment, the invention relates to compositions and methods using the proteins of the invention or part thereof such as ligands for substrates of interest. In a preferred embodiment, the proteins of the invention or part thereof may be used to identify and/or quantify substrates using any techniques known to those skilled in the art such as those described in Koonin E., supra. In another preferred embodiment, the proteins of the invention or part thereof may be used to improve or to modify some molecular biology methods based on protein-protein interactions, including but not limited to two-hybrid assays, expression and purification systems based on GST fusion to heterologous proteins as already available commercially (expression vectors or plasmids encoding fusions proteins and affinity purification methods).

In still another embodiment, the invention relates to methods and compositions using the proteins of the invention or part thereof as a marker protein to selectively identify tissues, preferably fetal brain for the protein of SEQ ID NO: 403, and preferably fetal brain and ovary for the protein of SEQ ID NO: 395. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

In another embodiment of the invention, measurement of the activity or expression of the proteins of the invention, may be used for the assessment of organ status, including organ damage following immunological or toxological insult and diagnostic of transplant rejection, using any technique known to those skilled in the art including those described in U.S. Pat. No. 6,080,551 and RE 35,419.

In another embodiment of the invention, the proteins of the invention or part thereof, or derivative thereof, may be used to diagnose, treat and/or prevent cell proliferative disorders linked to dysregulation of gene expression of the proteins of the invention. Such disorders include but are not limited to, benign tumors, and cancers such as adenocarcinoma; leukemia; melanoma; lymphoma; sarcoma; and cancers of the brain, ovary, bladder, colon, liver, small intestine, large intestine, breast, kidney, lung, and prostate. Diagnosis may be performed using nucleic acids or antibodies able to detect the expression of the protein of the invention using any technique known to those skilled in the art including Northern blotting, RT-PCR, immunoblotting methods immunohistochemisty, enzyme-linked immunosorbant assay (ELISA) described herein. Quantities of the protein of the invention expressed in subject samples, control and disease from biopsied tissues or body fluids or cell extracts taken from patients are compared with the standard values. Deviation between standard and subject values establishes the parameters for diagnosing disease.

For prevention and/or treatment purposes, the expression of the proteins of the invention may be enhanced using any methods known to those skilled in the art. For example, gene therapy techniques may be used such as the delivery of sense promoter polynucleotide constructs for the proteins of the invention or part thereof using a recombinant expression vector such as a chimeric virus or a colloidal dispersion system (see Nelson et al. U.S. Pat. No. 552,277). Alternatively, the proteins of the invention or fragments thereof or derivatives thereof may be administered to a subject to treat or prevent cancerous and precancerous disorders as well as a proliferative disorders in general. Such disorders can include, but are not limited to, syndromes represented by abnormal neoplastic, including dysplastic, changes of tissue, dysplastic growths in ovary, brain, colonic, breast, prostate or lung tissues, dysplastic nevus syndromes, polyposis syndromes, colonic polyps, precancerous lesions of the cervix (i.e., cervical dysplasia), esophagus, lung, prostatic dysplasia, prostatic intraneoplasia, breast and/or skin and related conditions (e.g., actinic keratosis), whether the lesions are clinically identifiable or not.

The invention also relates to compositions and methods using the proteins of the invention or part thereof or derivative thereof to decrease drug resistance in cancer chemotherapy. Inhibition of the expression and/or activity of the proteins of the invention may be achieved using any mean known to those skilled in the art. In a preferred embodiment, gene therapy methods such as antisense oligonucleotides, triple helices strategies are described elsewhere in the application. In another preferred embodiment, antagonists of the activity of the proteins of the invention may be used. These antagonists may be directly administered to patients. Low-molecular-weight inhibitors (i.e., those which can be delivered freely into the brain and which specifically inhibit GST activity) are especially preferred for use in cancer therapy. Alternatively, artificial DNA constructs encoding peptide modulators or inhibitors of the activity of the protein of the invention and flanking sequences effective to express the protein coding sequence in a host cell as well as flanking regulatory sequences (such as an antioxidant responsive element which enhances the expression of the glutathione S-transferase in the presence of antioxidant molecules) may be used. Such artificial DNA constructs confers to recombinant cells an increased level of resistance to an antineoplastic agent.

There is a need for selective inhibitors of GST isoenzymes for treatment of drug resistance in cancer patients. Thus, in a further embodiment of this invention, the proteins of the invention or fragments thereof can be used for screening of the compounds which are selective inhibitors or specific inhibitors of one or more GST isoenzymes. Selective inhibition means that a compound has a greater inhibitory effect on one isoenzyme than it does on another GST isoenzyme. Such compounds could also be tested and selected for their ability to overcome drug resistance to chemotherapeutic agents (see Jones, et al. U.S. Pat. No. 6,103,665 August 2000). For example, mammalian cell lines that have been made resistant to particular chemotherapeutic drugs can be used to identify haloenol lactone compounds that render the lines sensitive to the chemotherapeutic agents. Such cell lines are known to those of skill in the art and can be obtained for example from the American Type Culture Collection, Rockville, Md., USA.

Protein of Seq Id No: GRP (187-38-0-0-110-CS)

The protein of SEQ ID No: 306, herein referred as GRP, encoded by the cDNA of SEQ ID No: 65 herein referred as GRP2, is homologous to bovine glutamic-acid rich protein (GARP) (GENEPEPT ID: M61185). The protein of the invention is overexpressed in the brain and fetal brain, lymph ganglia and thyroid.

The protein of the invention exhibits homology with bovine glutamic-acid rich protein (GARP) (18% identical amino acids, 28% positive amino acids when aligned by BLASTP 2.0.9).

GARP proteins have been identified as multivalent proteins that interact the key players of cGMP signaling, phosphodiesterase and guanylate cyclase. GARP proteins are closely associated to cyclic nucleotide-gated channels (CNGs) which make up a family of nonselective cation channels found in a variety of tissues. The beta subunit of CNGs have a unique bipartite structure, containing a membrane-spanning region (beta part) and a GARP part (GARP). GARP is highly homologous to a soluble splice form, GARP1, and a splice variant lacking the C-terminal glutamic-acid-rich region. Experiments using GARP attached to affinity columns showed that phosphodiesterases are highly retained by the column [Korschen H G et al., Nature, 400(6746):761–766 (1999)]. Moreover, Korschen et al. demonstrated that GARP inhibits both soluble and membrane bound phosphodiesterase.

Cyclic nucleotides are involved in regulating the activity of airway smooth muscle and many other cells in the airways, including pro-inflammatory, immunocompetent cells such as macrophages, eosinophils, mast cells and lymphocytes. Cyclic nucleotides are inactivated by the action of cyclic nucleotide phosphodiesterase enzymes (PDE). Inhibition of cGMP PDE results in elevation of cGMP levels; elevated cGMP levels are associated with beneficial anti-platelet, anti-neutrophil, anti-vasospastic and vasodilatory activity.

Thus, the subject invention provides a polypeptide having the sequence of SEQ ID No: 306 or a GRP polypeptide encoded by the human cDNA of clone 187-38-0-0-110. In a preferred embodiment, GRP is encoded by the sequence of SEQ ID No: 65 or the human cDNA of clone 187-38-0-0-110, however, all polynucleotides encoding the polypeptides of the invention are included. As used herein, "the GRP protein" includes the full length protein of SEQ ID NO: 306 as well as biologically active fragments of the GRP protein. Also encompassed by the phrase "the GRP protein" are variants of the protein of SEQ ID NO: 306 and biologically active fragments of said variant proteins.

"Biologically active fragments" are defined as those peptide or polypeptide fragments of GRP which have at least one of the biological functions of the full length protein (e.g., the ability to inhibit the activity of PDE or serve as an affinity substrate for PDEs).

The invention also provides variants of the protein of the GRP protein encoded by SEQ ID NO: 306. These variants have at least about 80%, more preferably at least about 90%, and most preferably at least about 95% amino acid sequence identity to the amino acid sequence of GRP. Variants according to the subject invention also have at least one functional or structural characteristic of GRP, such as the ability to inhibit the activity of PDE or serve as an affinity substrate for PDEs. The invention also provides biologically active fragments of the variant proteins. Unless otherwise indicated, the methods disclosed herein can be practiced utilizing GRP or variants thereof. Likewise, the methods of the subject invention can be practiced using biologically active fragments of GRP, or biologically active fragments of GRP variants.

Assays related to the inhibitory effect of the protein of the invention can be carried out using techniques described in U.S. Pat. No. 6,130,333, hereby incorporated by reference in its entirety; or by any other technique known to those skilled in the art.

One aspect of the subject invention provides compositions and methods of using the nucleotide sequence of SEQ ID NO: 65, or its complement, in molecular biology techniques. These techniques include, but are not limited to: the use of segments of GRP2 as oligomers for PCR; expression of the GRP2 and the production of recombinant proteins; in generation of antisense RNA and DNA, their chemical analogs and the like; the use of GRP2 segments as hybridization probes and in chromosome gene mapping.

For example, nucleotide sequence of SEQ ID No: 65, or its complement, can be used to generate hybridization probes for mapping the naturally occurring genomic sequence. The sequence can be mapped to a particular chromosome or to a specific region of the chromosome using well-known techniques. These include in situ hybridization to chromosomal spreads, flow-sorted chromosomal preparations, or artificial chromosome constructions such as yeast artificial chromosomes, bacterial artificial chromosomes, bacterial P1 constructions, or single chromosome cDNA libraries as reviewed in Price (Price C M—Blood Rev.—1993, 7(2):127–34) and Trask B (Trask B J—Trends Genet.—1991, 7(5):149–54).

In situ hybridization of chromosomal preparations and physical mapping techniques, such as linkage analysis using established chromosomal markers, are invaluable in extending genetic maps; genetic maps provide valuable information to investigators searching for disease-causing genes using positional cloning or other gene discovery techniques. The nucleotide sequence of the present invention can also be used to detect differences in the chromosomal location due to translocation, inversion, etc. among normal, carrier or affected individuals.

Another embodiment of the subject invention provides pharmaceutical compositions comprising the GRP protein and pharmaceutically acceptable carriers. These pharmaceutical compositions can be used in prophylaxis and/or treatment of a variety of conditions where inhibition of phosphodiesterase is considered to be beneficial. The biochemical, physiological, and clinical effects of phosphodiesterases inhibitors suggest their utility in a variety of disease states in which modulation of smooth muscle, renal, hemostatic, inflammatory, and/or endocrine function is desirable. Therefore, the GRP protein can be used for the treatment or prophylaxis of a number of disorders and conditions including, but not limited to, stable, unstable, and variant (Prinzmetal) angina; hypertension; pulmonary hypertension; congestive heart failure; acute respiratory distress syndrome; acute and chronic renal failure; atherosclerosis; conditions of reduced blood vessel patency (e.g., postpercutaneous transluminal coronary or carotid angioplasty, or post-bypass surgery graft stenosis); peripheral vascular disease; vascular disorders, such as Raynaud's disease, thrombocythemia, intermittent claudication; immune diseases, multiple sclerosis; cancers inflammatory diseases, graft versus host disease, Alzheimer's disease, memory deficits, stroke, bronchitis, chronic asthma, acute lung injury, chronic obstructive pulmonary disease, allergic asthma, allergic rhinitis; glaucoma; osteoporosis; preterm labor; benign prostatic hypertrophy; male and female erectile dysfunction; and diseases characterized by disorders of gut motility (e.g., irritable bowel syndrome).

The GRP protein of the invention can also provide beneficial anti-platelet, anti-neutrophil, anti-vasospastic, vasodilatory, natriuretic, and diuretic activities when administered in therapeutically effective amounts. The GRP protein can also potentiate the effects of endothelium-derived relaxing factor (EDRF), gastric NO administration, nitrovasodilators, atrial natriuretic factor (ANF), brain natriuretic peptide (BNP), C-type natriuretic peptide (CNP), and endothelium-dependent relaxing agents such as bradykinin and acetylcholine, when administered to an individual.

Another embodiment of the subject provides methods of treating male erectile dysfunction comprising the administration of therapeutically effective amounts of the GRP protein using appropriate methods known to the skilled artisan.

Another embodiment of the subject invention provides industrially significant methods of recovering PDE comprising contacting solutions containing PDE with immobilized GRP protein. In this aspect of the invention, the GRP protein is immobilized onto a solid support and allowed to specifically bind to PDE contained in a solution or sample. PDE can then be eluted from the immobilized GRP protein according to methods known to the skilled artisan (see, for example, Korschen et al., supra). PDE is a commercially valuable commodity sold by various vendors.

Protein of SEQ ID NO: 302 (Internal Designation 187-2-2-0-A3-CS)

The protein of SEQ ID NO: 302, NEURVANA, encoded by the cDNA of SEQ ID No: 61 is related to a neuronally expressed protein (neuritin, Genseq accession number W37859) known to have a role in neuritigenesis and axonal and dendritic growth.

The 164 amino acid Neurvana protein of SEQ ID NO: 302 is related to Neuritin, also known as candidate plasticity-related gene number 15 (cpg-15). Neuritin was independently identified by two groups from differential cDNA libraries generated from kainic acid-treated hippocampal cells (Nedivi et al., Nature. 363:718–22 (1993); Naeve et al., Proc. Natl. Acad. Sci. USA. 94:2648–53 (1997)). Neuritin is a secreted protein that contains a potential GPI anchoring domain believed to anchor the protein to the membranes of target cells. Neuritin is expressed strongly in the brain, and in particular, in systems with pronounced developmental plasticity, including the pyramidal neurons of the cornus ammons and the granule cells of the hippocampus dentate gyrus. Strong expression is also observed in layers of tenia tecta projecting to the olfactory bulb, the major target of the retinal ganglion cells, and the optical nerve layer of the superior colliculus (optic tectum); and localized expression is observed in the thalamic nuclei and the cerebral cortex (Nedivi et al., Pro. Natl. Acad. Sci. USA. 93:2048–53 (1996); Naeve et al., Proc. Natl. Acad. Sci. USA. 94:2648–53 (1997); Nedivi et al., Science. 281:1863–66 (1998)). mRNA is expressed throughout development and persists into adulthood. In addition, neuritin expression is upregulated in adults by brain derived neurotrophic factor (BDNF). Neuritin mRNA is also detected in the lung and the liver, although at lower levels than that observed in the CNS (Naeve et al., Proc. Natl. Acad. Sci. USA. 94:2648–53 (1997)).

Functional studies on the neuritin protein have revealed a role in neuronal growth. In one such study, rat cortical and hippocampal neurons were treated with recombinant forms of neuritin. Neurons treated with neuritin showed extensive neuritogenesis over control cultures. Specifically, neurons showed well-differentiated cell bodies with well-defined extensions after treatment with neuritin (Naeve et al., Proc. Natl. Acad. Sci. USA. 94:2648–53 (1997)). Other studies using frog optic tectum showed that transfection of tectum cells with neuritin cDNA can increase the growth rate of tectal cell dendrites (Nedivi et al., Science. 281:1863–66 (1998)). Studies have also shown that neuritin can modify the growth of retinotectal axons by increasing the elaboration of presynaptic axons and can promote the maturation of retinal tectal synapses (Cantallops et al., Nature Neuroscience. 3:1004–1011 (2000)). Together, these results indicate that neuritin promotes the growth of pre- and postsynaptic neurons and contributes to the formation and stabilization of mature synapses.

The subject invention provides the polypeptide of SEQ ID NO: 302 and polynucleotide sequences encoding the amino acid sequence of SEQ ID NO: 302. In one embodiment, the polypeptides of SEQ ID NO: 302, including fragments, variants, etc. are replaced by the corresponding polypeptide encoded by the human cDNA of clone 187-2-2-0-A3-CS. Also included in the invention are biologically active fragments of the protein of SEQ ID NO: 302 and polynucleotide sequences encoding these biologically active fragments. In another embodiment, biologically active fragments comprise amino acid positions 41–60, 66–117, 41–117, and 41–164. In another embodiment, these fragments may be joined together by chemical linkers or by recombinantly inserted amino acid linker segments according to methods known in the art. "Biologically active fragments" are defined as those peptide or polypeptide fragments of SEQ ID NO: 302 which have at least one of the biological functions of the full length protein (e.g., the ability to stimulate neuritigenesis and axonal and dendritic growth).

The invention also provides variants of SEQ ID NO: 302. These variants have at least about 80%, more preferably at least about 90%, and most preferably at least about 95% amino acid sequence identity to the amino acid sequence of SEQ ID NO: 302. Variants according to the subject invention also have at least one functional or structural characteristic of SEQ ID NO: 302, such as the biological functions described above. The invention also provides biologically active fragments of the variant proteins. Unless otherwise indicated, the methods disclosed herein can be practiced utilizing the polypeptide of SEQ ID NO: 302 or variants thereof. Likewise, the methods of the subject invention can be practiced using biological fragments of the protein of SEQ ID NO: 302 or variants of said biologically active fragments.

Because of the redundancy of the genetic code, a variety of different DNA sequences can encode SEQ ID NO: 302. It is well within the skill of a person trained in the art to create these alternative DNA sequences, which encode proteins having the same, or essentially the same, amino acid sequence. These variant DNA sequences are, thus, within the scope of the subject invention. As used herein, reference to "essentially the same sequence" refers to sequences that have amino acid substitutions, deletions, additions, or insertions that do not materially affect biological activity. Fragments retaining one or more characteristic biological activity of SEQ ID NO: 302 are also included in this definition.

"Recombinant nucleotide variants" are alternate polynucleotides which encode a particular protein. They can be synthesized, for example, by making use of the "redundancy" in the genetic code. Various codon substitutions, such as the silent changes which produce specific restriction sites or codon usage-specific mutations, can be introduced to optimize cloning into a plasmid or viral vector or expression in a particular prokaryotic or eukaryotic host system, respectively.

The protein of SEQ ID NO: 302, and variants thereof, can be used to produce antibodies according to methods well known in the art. The antibodies can be monoclonal or polyclonal. Antibodies can also be synthesized against immunogenic fragments of SEQ ID NO: 302, as well as variants thereof, according to known methods. The subject invention also provides antibodies which specifically bind to biologically active fragments of SEQ ID NO: 302 or biologically active fragments of SEQ ID NO: 302 variants.

The protein of SEQ ID NO: 302 can be utilized to treat diseases and disorders of the central or peripheral nervous system which arise from alterations in the pattern of expression of the protein of SEQ ID NO: 302. In this aspect of the subject invention, compositions comprising the protein of SEQ ID NO: 302 and a pharmaceutical carrier are administered to an individual in need thereof. Alternatively, in cases where the protein of SEQ ID NO: 302 is overexpressed, reductions in SEQ ID NO: 302 levels may be accomplished by a variety of methods known to those of skill in the art. These methods include the introduction of neutralizing antibodies or the use of antisense polynucleotides derived from the protein of SEQ ID NO: 302 or clone 187-2-2-0-A3-CS.

The subject invention also provides materials and methods for the treatment of neurological disorders comprising contacting neuronal cells with compositions comprising the protein of SEQ ID NO: 302 and pharmaceutically acceptable carriers. Thus, this aspect of the invention provides methods of treating patients suffering from a variety of neurological disorders, conditions, and/or diseases of the central, autonomic, or peripheral nervous system. These include neurological damage arising from congenital disease, trauma, surgery, stroke, ischemia, infection, metabolic disease, nutritional deficiency, malignancy, and/or exposure to toxic agents. Additional examples of such disorders include, but are not limited to, epilepsy, cerebral neutralisms, Alzheimer's disease, Pick's disease, Huntington's disease, dementia, Parkinson's disease and other extrapyramidal disorders, amyotrophic lateral sclerosis and other motor neuron disorders, progressive neural muscular atrophy, retinitis pigmentosa, hereditary ataxias, multiple sclerosis and other demyelinating diseases, bacterial and viral meningitis, brain abscess, subdural empyema, epidural abscess, auppurative intracranial thrombophlebitis, myelitis and radiculitis, viral central nervous system disease, prion diseases, Creutzfeldt-Jakob disease, Gerstmann-Staussler-Scheinker syndrome, fatal familial insomnia, diabetes induced peripheral neuropathy or neuropathy induced by other metabolic disorders or nutritional deficiencies, neurofibromatosis, tuberous sclerosis, cerebelloretinal hemangioblastomatosis, encephalotrigeminal syndrome, mental retardation and other developmental disorders of the central nervous system, cerebral palsy, neuroskeletal disorders, autonomic nervous system disorders, cranial nerve disorders, spinal cord diseases, muscular dystrophy and other neuromuscular disorders, dermatomyositis and polymyostis, inherited, metabolic, endocrine, and toxic myopathies, myasthenia gravis, periodic paralysis, mental disorders including mood, anxiety, and schizophrenic disorders, seasonal affective disorder, akathesia, amnesia, and/or other dystrophies or degenerative disorders of the visual, sensory, olfactory, auditory, motor, or memory systems. Methods of introducing therapeutic compounds into cells are known to those skilled in the art. Non-limiting examples include the use of targeted liposomes, fusogenic liposomes, or other carriers suitable for the introduction of a therapeutic compound into a target cell.

The subject invention also provides materials and methods for stimulation of proliferation of neuronal cells and axonal cell growth comprising contacting neuronal cells with compositions in comprising a Neurvana polypeptide or polynucleotide encoding the same. In one embodiment, the polynucleotide comprises the cDNA of clone 187-2-2-0-A3-CS. Methods of introducing polynucleotides into cells and directing expression of the polynucleotide are known to those skilled in the art.

Antibodies raised against the protein of SEQ ID NO: 302 may be used in a variety of immunoassays known to those skilled in the art. In this aspect of the invention, immunoassay screening for abnormal levels of the protein of SEQ ID NO: 302 can be used as screens or diagnostic/prognostic indicators of neurodegenerative disease.

Antibodies raised against the protein of SEQ ID NO: 302, fragments, and/or derivatives thereof may also be used for detection and identification of growing and differentiating neurons including, but not limited to, the pyramidal neurons of the cornus ammons, the granule cells of the hippocampus dentate gyrus, neurons in layers of tenia tecta projecting to the olfactory bulb, the optical nerve layers of the superior colliculus (optic tectum), and neurons of the thalamic nuclei and the cerebral cortex.

Protein of SEQ ID NO:301 (187-12-4-0-A8-CS)

The protein of SEQ ID NO:301, PROLISTATIN encoded by the cDNA of SEQ ID NO:60, is related to the Eukaryotic cell growth inhibiting factor (GENESEQP: R95950) described in patent WO9617933. The protein of the invention is highly expressed in the brain, fetal brain, fetal liver and the prostate.

The protein Prolistatin of the invention is a cell growth inhibiting factor. Preferred polypeptides of the invention are those that comprise amino acids 221 to 287. Other preferred polypeptides of the invention are any fragment of SEQ ID NO:301 having any of the biological activities described herein. In the present invention, a cell inhibiting factor is defined as a peptide or protein that decreases, suppresses or terminates (reversibly or irreversibly) the growth of at least one type of cell such as, but not limited to, bacteria, yeast, vertebrate cells, mammalian cells and human cells, under ordinary culturing conditions known to those skilled in the art. Assay of the inhibiting activity of the invention can be carried out, for example, by evaluating the decrease in DNA synthesis as described in Patent WO 96/17933, or by measuring the number or density of cells using any standard method. For example, fibroblasts are transfected with a vector containing the DNA sequence coding for the protein of the invention or part thereof. Cells are then cultured in a standard medium, exposed to tritiated thymidine, and further cultured. The cultures are then fixed and stained with X-Gal, the blue stained galactosidase-expressing cells are counted under a microscope, and the ratio of cells showing dark particles in their nuclei due to tritiated thymidine uptake is determined. DNA synthesis inhibitory rates are calculated with the labeling index taking for reference (i.e. 0% inhibition) a culture of cells tranfected with a "blank" vector (i.e. not modified to contain the DNA coding for the protein of the invention or part thereof).

Aging at the cell level is associated with individual aging. The maximum possible number of divisions (division life span) of cultured cells is inversely proportional to individual age. Even if an aged cell is fused with a young or immortalized cell, DNA synthesis does not occur again in aged cells; on the contrary, DNA synthesis in the young and immortalized cell is suppressed (Stein G H et al.—Proc Nat Acad Sci.—1981, 78:p3025). This demonstrates that certain factors controlling cellular senescence are dominant, and that aged cells not only lack substances essential for their growth but also have substances that actively suppress DNA synthesis. Moreover, microinjections of mRNA, prepared from an aged cell, are known to inhibit DNA synthesis (Lumpkin C K et al.—Science—1986, 232:p393). Therefore as cells age, there are some genes that are newly expressed or whose expression is increased. Such genes play an important role, directly or indirectly, in cell aging.

Pereira-Smith et al. tested the complementation of a large number of immortalized human cells in fused pairs and demonstrated the presence of 4 groups of human aging genes (Pereira-Smith O M et al.—Proc Nat Acad Sci.—1988, 85:p6042). Clarifying the nature of aging-associated genes is not only important in understanding aging, both at the cellular and individual levels, but is also significant in that the use of these genes or gene products would enable the diagnosis of various aging-associated diseases and diseases caused by cellular senescence, the development of prophylactic/therapeutic drugs for such diseases, and their application as prophylactic/therapeutic drugs for various diseases involving uncontrolled cell growth such as, but not limited to, cancers.

In one embodiment of the present invention, the polypeptides and polynucleotides of the invention are used to specifically label cells of the brain, fetal brain, fetal liver and the prostate, as the protein is strongly expressed in these tissues. The ability to specifically detect these tissues, and cells derived from these tissues, has a number of uses, including for the determination of the history of tumor cells and for histological analyses.

An embodiment of the present invention invention relates to methods and compositions of using the Prolistatin protein of SEQ ID NO:301 or the cDNA of SEQ ID NO:60 or any part thereof, to inhibit cell proliferation, either in vitro or in vivo. The methods comprise the step of contacting a cell with a proliferation inhibiting amount of a Prolistatin polypeptide.

Another example pertains to the use of the protein of the invention as a reagent for terminating the cell cycle of cultured cells at a given time point, e.g., as a reagent for synchronizing cell division, avoiding the need to isolate specific cells (e.g. at the desired cell cycle phase) in cultures using techniques such as flow cytometry. Synchronization of the cell cycle can, for example, be achieved, e.g., by transfecting cells with an appropriate vector containing the DNA coding for the protein of the invention or part thereof, where expression of the protein results in growth inhibition.

Then, after a certain time, an inhibitor of Prolistatin, such as an anti-Prolistatin antibody, can be administered in order to enable the cells to resume growth (e.g. all at the S phase, when DNA is synthesized). Further, the ability to synchronize the cell cycle in an in vitro experimental system would provide improved assay precision or would facilitate any laboratory procedure or experiment involving a particular cell cycle stage. Use of the invention for in vitro inhibition of cell proliferation is not limited to the above examples; the invention is useful in many in vitro application that requires the inhibition of cellular proliferation.

Another embodiment of the invention pertains to the introduction of SEQ ID NO:301 or SEQ ID NO:60, or any part thereof, into a target tissue (such as skin or vascular endothelium) to establish an in vitro aged cell line of the target tissue. Such a cell line is useful as a screening system for clarifying the mechanisms of aging and/or cellular senescence, but also for seeking prophylactic and therapeutic drugs for aging-associated diseases and or diseases caused by cellular senescence, as it provides an in vitro model of aged cells (in vitro cell cultures provide the advantage of being easily produced and are not as expensive as animal models). Thus these cells are potentially useful in drug candidate screening applications; a preferred application involves its use in high-throughput screening, e.g. to identified "lead compounds."

A preferred embodiment of the invention relates to the use of the cDNA of SEQ ID NO:60 or part thereof, as a probe for examining individual aging at the gene expression level. Specifically, SEQ ID NO:60, or part thereof, can be used as a diagnostic reagent for various aging-associated diseases such as, but not limited to: arteriosclerosis, osteo-arthritis, dementia (including Alzheimer's disease) and Parkinson's disease.

In a related embodiment, the cDNA of SEQ ID NO:60 or part thereof, could be used to synthesize antisense oligonucleotides by methods well known to those skilled in the art. Antisense oligonucleotides can be used to inhibit the synthesis of the protein of SEQ ID NO:301, thereby preventing cell and tissue aging and/or promoting the rejuvenation of aged cells and tissues. These antisense oligonucleotides can also be used for in vivo or ex vivo treatment and prophylaxis of diseases caused by cellular senescence or aging-associated diseases such as, but not limited to: arteriosclerosis, osteo-arthritis, dementia (including Alzheimer's disease) and Parkinson's disease.

In a most preferred embodiment, SEQ ID NO:301, SEQ ID NO:60, or any part thereof, can be used as a pharmaceutical drug to treat pathologies such as, but not limited to cancers, inflammation, or infections. For example, when used as an antibacterial, antiviral and/or antifungal agent, inhibition of microbial proliferation could be achieved by either directly inhibiting microorganism growth (in the case of fungal and bacterial infections) or DNA synthesis of infected cells in the case of viral infections. The DNA of SEQ ID NO:60 or part thereof, can also be used to develop gene therapy products in the in vivo or ex vivo treatment of diseases and conditions such as cancers and inflammation. SEQ ID NO:301, SEQ ID NO:60, or any part thereof, may also be used: 1) as a probe for the diagnosis, 2) as a prophylaxis or 3) as a treatment of aging-associated diseases such as, but not limited to: arteriosclerosis, osteo-arthritis, dementia (including Alzheimer's disease) and Parkinson's disease. In a related embodiment, the protein of SEQ ID NO:301 or the cDNA of SEQ ID NO:60, or any part thereof, can be used in the development of drugs that will be used in the prophylaxis or treatment of the diseases stated above (e.g. diseases caused by cellular senescence, aging-associated diseases and diseases caused by cellular proliferation).

For the treatment or prevention of diseases and conditions associated with undesired proliferation, such as cancer, inflammation, or infection, the expression or activity of the present protein can be increased using any of a number of methods. For example, polynucleotides encoding the protein can be introduced into the undesired cells, wherein the protein is then expressed and inhibits the further growth of the cells. In one such embodiment, the polynucleotides can be incorporated into liposomes comprising on their surface a specific molecule that directs the targeting of the liposome to a specific cell type (e.g. a tumor-specific antibody). Alternatively, the protein of SEQ ID NO:301 can itself be administered to the cells, e.g. as a fusion protein also comprising a specific targeting polypeptide moiety. Further, a compound that enhances the expression or activity of the protein can be administered to cells, preferably in a way that specifically targets the compound to undesired cells, e.g. chemically linked to a heterologous specific targeting molecule.

Protein of SEQ ID NO: 412 (Internal Designation 187-5-3-0-C7-CS)

The protein of SEQ ID NO: 412 encoded by the cDNA of SEQ ID NO: 171 is homologous to the human CDK4-binding protein p34$^{SEI-1}$ (sptrembl accession number Q9UHV2). p34$^{SEI-1}$ is a new CDK4 regulator that prevents p16INK4a from inhibiting the formation of cyclinD1-CDK4 complexes. p34$^{SEI-}$ seems to act as a growth factor sensor and may facilitate the formation and activation of cyclin D-CDK complexes in the face of inhibitory levels of INK4 proteins (Sugimoto et al., Genes Dev. 13:3027–3033 (1999)).

Progression through the cell cycle is a complex process that is regulated at many levels by several proteins. The activity of cyclin dependent kinases (CDK4 and CDK6) is regulated by the association of cyclin partner that acts as a positive effector and by two families of cdk inhibitors proteins (KIP) and the inhibitors of cdk4 (INK4) such as p16INK4a, which act as negative effectors (Sandhu et al., Cancer Detect. Prev.24:107–118 (2000)).

Cancer is a disease characterized by loss of cellular growth control, the molecular machinery of the cell cycle is involved in tumorigenesis. Many human tumors have been shown to have abnormality in this pathway resulting in either the functional inactivation of p16INK4a or the excessive activity of CDK4 (Palmero at al., Cancer Surv.27:351–357 (1996)).

It is believed that the protein SEQ ID No: 412 plays a role in the cell cycle regulation via the binding to a cyclin dependent kinase. Other preferred polypeptides of the invention are fragments of SEQ ID NO: 412 having any of the biological activity described herein. The binding activity of the protein of the invention or part thereof to a cyclin dependent kinase, as well as its role in cell cycle, may be assayed using any of the assays known to those skilled in the art including those described in Sugimoto et al., supra.

An embodiment of the present invention relates to methods of using the protein of the invention or part thereof to identify and/or quantify cyclin dependent kinases, preferably CDK4, in a biological sample, and thus used in assays and diagnostic kits for the quantification of such CDKs in bodily fluids, in tissue samples, and in mammalian cell cultures. The binding activity of the protein of the invention or part thereof may be assessed using the assay described in Sugimoto et al., supra or any other method familiar to those skilled in the art. Preferably, a defined quantity of the protein of the invention or part thereof is added to the sample under conditions allowing the formation of a complex between the protein of the invention or part thereof and the cyclin dependent kinase to be identified and/or quantified. Then, the presence of the complex and/or or the free protein of the invention or part thereof is assayed and eventually compared to a control using any of the techniques known by those skilled in the art.

In another embodiment, the invention relates to compositions and methods using the protein of the invention or part thereof to stimulate cell proliferation both in vitro and in vivo. For example, soluble forms of the protein of the invention or part thereof may be added to cell culture medium in an amount effective to stimulate cell proliferation.

The invention further relates to methods and compositions using the protein of the invention or part thereof to diagnose, prevent and/or treat several disorders associated with cell proliferation including but are not limited to, adenocarcinoma, sarcoma, lymphoma, leukemia, melanoma, myeloma, teratocarcinoma, cancers of the adrenal gland, bladder, bone, brain, breast, gastrointestinal tract, heart, kidney, liver, lung, ovary, pancreas, paraganglia, parathyroid, prostate, salivary gland, skin, spleen, testis, thyroid, uterus, and neurodegenerative disorders such as Alzheimer's disease (McShea et al., Am. J. Pathol. 150(6):1933–1939 (1997)). For diagnostic purposes, quantification of the protein of the invention could be investigated, using Northern blotting, RT-PCR, immunoblotting and any of protocols known in the art, in biological samples and compared to the expression in control biological samples. Thus a diagnosis assay may be used, to determine altered expression of the protein of the invention, to correlate with diseases states and to evaluate the prognostic significance in diseases. For prevention and/or treatment purposes, inhibition of the endogenous expression of the protein of the invention using any of the antisense or triple helix methods described herein may be used. Alternatively, inhibitors for the protein's activity may be developed and use to inhibit and/or to reduce the protein's activity using any methods known to those skilled in the art. Antibodies which specifically bind to the protein of the invention may be generated using methods that are well known in the art and used as an antagonist.

Protein of SEQ ID NO: 299 (Internal Designation 184-1-4-0-C11-CS)

The protein of SEQ ID NO: 299 encoded by the cDNA of SEQ ID NO: 58 and found in fetal liver and liver, is orthologous to the BolA protein. The BolA family comprises the morpho-protein BolA from *E. coli* and its various homologs. The expression of BolA is growth rate regulated and is induced during the transition into the stationary phase. BolA is also induced by stress during early stages of growth and can have a general role in stress response. It has also been suggested that BolA can induce the transcription of penicillin binding protein 6 and 5 (EMBO J. 1: 8 (2):3923–31 (1989))

*E. coli* cells become thinner and shorter after a period of starvation or stationary-phase conditions; this altered morphology is an adaptative response of *E. coli* to general forms of stress. The bolA gene seems to be involved in the switching between cell elongation and septation systems during the cell division cycle [J Bacteriol 170:5169–5176 (1988)]. The regulation of bolA has been linked to the presence of gearbox promoter from which RNA is transcribed [Mol Microbiol 5:2085–2091 (1991)].

Expression of bolA is governed by two promoters. P2 is located further upstream from the structural gene, is under the control of $\sigma^d$ and transcribes bolA constitutively. The promoter P1, proximal to the structural gene, is a gearbox promoter under the control of $\sigma^s$ from which bolA has been shown to be transcribed in an inverse growth rate-dependent fashion [J Bacteriol 173:4474–4481 (1991)].

The alternate sigma factor $\sigma^s$ is encoded by the gene rpoS and has been described as a central regulator for the induction of a set of specific genes involved in adaptation to stationary phase. It has, nevertheless, been shown that $\sigma^s$ function is not confined to stationary phase. Significant increases in $\sigma^s$ cellular levels were seen during exponential growth in response to forms of stress; genes under its control code for important adaptive regulators for general stress conditions [FEMS Microbiol Lett 30:419–430 (1997)].

The smaller morphology caused by stress-induced overexpression of bolA reduces the surface area exposed to the environment and decreases the cell's surface to volume ratio.

Identification of ortholog genes provides important information regarding functional and structural conservation within these orthologs throughout evolution. The concept of comparative gene identification has been previously used by many laboratories to search for orthologous genes once a particular gene of interest has been identified in another species [Genome Res 10 (5): 703–13 (2000)].

The protein of invention contains a signal peptide corresponding to a short helix as predicted by software TopPred II [Clarosand and von Heijne, CABIOS applic. Notes, 10: 685–686 (1994)]. Thus, one aspect of this invention provides materials and methods for the delivery of recombinant proteins to liver cells. The signal peptide, encoded by an appropriate polynucleotide, can be linked to another protein/polypeptide (also encoded by an appropriate polynucleotide). The recombinant gene, containing the signal peptide sequence, is expressed and the desired protein is delivered via the signal peptide. Methods of producing such gene fusions, the expression of such gene products, and their use are well known to the skilled artisan.

In another embodiment, BolA, or biologically active fragments thereof, can be used to modulate the stress response to environmental changes such as cytotoxic agents, heat shock, irradiation, genotoxic stress or growth factors.

In another aspect of the invention, SEQ ID NO: 299 is incorporated into a prokaryotic expression vector and transfected into prokaryotic cells unable to adapt to environmental stress or cells containing a BolA defect. The expression vector can, optionally, contain a promoter system such as that described supra (e.g., P1, P2, $\sigma^d$, $\sigma^s$, etc.) which typically controls bolA expression. The components necessary for transcription can be provided in one or more expression vectors. Prokaryotic cells thus transformed can be useful in bioremediation systems where environmental stress is commonly encountered. Thus, preferred prokaryotes for the practice of this aspect of the invention lack bolA, or contain a bolA defect, and are known to be useful for bioremediation.

In another embodiment, the subject invention provides methods and compositions to selectively identify liver tissues. The protein encoded by SEQ ID NO: 299 can be used to synthesize specific polyclonal or monoclonal antibodies using any techniques known to those skilled in the art. These antibodies can be used to selectively identify liver tissue according to well-known histological immunoassays. The ability to immunologically identify tissue samples is industrially important for analysis of mismarked biopsy samples (e.g., laboratory errors) where the origin of the tissue sample is in question, or simply to verify that a tissue sample originated from liver. The antibodies can also be used to identify cancer metastases originating from the liver.

Further, antibodies provided by the subject invention can also be used to assay animal feeds for the presence of liver or liver by-products. As is known, many animal feeds contain animal protein. The use of animal feeds containing animal protein has been associated with disorders in both animals and humans (the most notorious of which is bovine spongiform encephalitis). This has resulted in the banning of animal protein in feeds provided to animals. However, to ensure compliance with such bans, animal feeds must be tested. Thus, the antibodies of the invention can be used to test animal feeds for the presence of liver according to methods known to those skilled in the art.

Proteins of SEQ ID NOs: 249 and 288 (Internal Designation 105-037-2-0-H11-CS and 174-7-4-0-H1-CS respectively).

The 403-amino-acid-long protein of SEQ ID NO: 249 encoded by the cDNA of SEQ ID NO: 8 is extensively homologous to the protein of SEQ ID NO: 288 encoded by the cDNA of SEQ ID NO: 47 with the exception of five amino acids in positions 192–194, and 298–299 which are not present in protein of SEQ ID NO: 288. It is likely that the two proteins are the result of an alternative splicing and display similar functions and utilities.

The 403-amino-acid-long protein of SEQ ID NO: 249, overexpressed in salivary glands, exhibits extensive homology to the mus musculus hypothetical protein (Genbank accession number AB030196). The amino acid residues of protein of SEQ ID: 249 show a high degree of identity to the Genbank sequence. However, the protein of Genbank sequence does not have the twenty amino acids (192 to 194, and 298–303, 353–354, 380–381, and 387–393) and also displays 35 different a from the SEQ ID NO: 249. In addition, four transmembrane domains are predicted for the protein of SEQ ID NO: 249 from positions 31 to 51, 75 to 95, 154 to 174, and from 236 to 256 as predicted by the software TopPred II (Claros and von Heijne, *CABIOS applic. Notes*, 10: 685–686 (1994)).

When expressed in *E. Coli*, the matched sequence suppresses bacterial growth (Inoue et al, Biochem Biophys Res Commun 268:553–61 (2000)). It is therefore believed that the proteins of SEQ ID NO: 249 and 288 or a bacterial growth suppressing fragment thereof can be used to suppress bacterial growth by contacting bacteria (gram negative or gram positive) with the polypeptides of the invention. The growth inhibiting activity of the protein of the invention or part thereof may be assayed using any of the assays known to those skilled in the art including those described in Inoue et al, supra.

In accordance with one aspect of the invention, methods and compositions using the protein of the invention or a fragment thereof to suppress bacterial growth are provided. In a preferred embodiment, the protein of the invention is expressed in a bacteria, preferably *E. coli*, using recombinant DNA technology methods known to those skilled in the art. The expressed protein can then be used to inhibit bacterial growth. The effects of the expressed protein and analogs or antagonists thereof can be assessed using any methods or techniques known to those skilled in the art.

Further included in the invention are the polypeptides encoded by the human cDNA of clone 105-037-2-0-H11-CS-SD. The polypeptides of SEQ ID NO: 249 may be interchanged with the corresponding polypeptides encoded by the human cDNA of clone 105-037-2-0-H11-CS-SD. Further included in the invention are polynucleotides encoding said polypeptides. Preferred polynucleotides are those of SEQ ID NO: 8 and of the human CDNA of clone 105-037-2-0-H11-CS-SD.

Nucleotide sequences encoding the polypeptides of SEQ. ID. NOs: 249 and 288 can be used to generate probes for the detection of related genes. Vectors expressing the nucleotide sequence can be used can be used to express the polypeptide in target cells. Antisense nucleotides can be used to inhibit the expression of the polypeptide.

Thus, in another embodiment of the invention the protein or a fragment thereof can be used as a marker protein to selectively identify tissues, preferably salivary glands. For example, the protein of the invention or a fragment may be used to synthesize specific antibodies using any techniques known to those skilled in the art. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry. In another embodiment, polynucleotides encoding the protein of SEQ. ID. NO. 249 can be used for in situ hybridization.

The transcript coding for the protein gng31g (Genebank accession number AF069954) is transcribed from a bidirectional promoter divergently with the transcript coding for the gamma 3 subunit protein called gng3, a novel human G binding protein gamma-3 (HGPG) (Genbank accession number AF069953) and this organization is conserved across species within the human genome (*Downes et al, Genomics*, 53:220–230 (1998)).

Several genes which are linked in common physiological functions share a common divergently bidirectionnel promoter like αB crystallin and α crystallin, collagen type IV A1 and A2, surf1–3, and surf 5 genes, dihydrofolate reductase and 2 mismatch repair1 (Iwaki et al., *Genomics*, 45: 386–394 (1997), Burbelo et al., *Proc. Natl. Acad. Sci. USA* 85: 9679–9682 (1988), Kaytes et al., *J. Biol. Chem*, 263: 19274–19277 (1988), Poschl et al., *EMBO J.*, 7:2687–2695 (1988), Soininen et al., *J. Biol. Chem*, 263: 17217–17220 (1988), Garson et al., *Genomics*, 30: 163–170 (1995), Williams et al., *Mol. Cell. Biol.*, 6: 4558–4569 (1986), Fujii et al., *J. Biol. Chem.*, 264: 10057–10064 (1989)). The heterodimeric G proteins, a family of GTPases are present in all cells and control a variety of functions (metabolic, humoral, neural and developmental) by transducing hormonal, neurotransmitter and sensory signals into an array of cellular responses. Triggered by cell surface receptors, each G protein regulate the activity of a specific effector including adenylate cyclase, phospholipase C, and ion channels protein which initiate appropriate biochemical responses. In view of this, it is believed that the transcript coding for the proteins of SEQ ID NO: 249 shares common regulatory elements with gng3 gene and that the products of such genes which are protein of SEQ ID NO: 249 and gng3 are physiologically coupled in unknown ways. Thus, in an embodiment of the invention, the protein of SEQ ID NO: 249 or part thereof may be used to regulate signal transduction of hormonal, neurotransmitter, and sensory signals to provide an array of cellular responses.

In yet another embodiment of the invention, the polypeptides of the present invention and the related polynucleotides may be used to treat several types of disorders including, but not limited to, cancer, neurodegenerative diseases, cardiovascular disorders, hypertension, renal injury and repair, septic shock.

In one embodiment, the protein of SEQ. ID. NO: 249 or a fragment, derivative or analog thereof may be administered to a subject to treat or prevent a disorder associated with decreased expression or activity of the protein.

In a further embodiment, a vector capable of expressing the protein of SEQ. ID. NO: 249 may be administered to a subject to treat or prevent a disorder associated with decreased expression or activity of the protein. Naked nucleotides encoding the protein of SEQ. ID. NO 249 may also be used.

In yet another embodiment, a pharmaceutical composition comprising a substantially purified the protein of SEQ ID NO: 249 may be administered to a subject to treat or prevent a disorder associated with decreased expression of the protein.

In still another embodiment, the polypeptide of SEQ ID NO: 249 can be used to develop and screen antagonists. For example, purified polypeptide can be used to develop antibodies or to screen libraries of pharmaceutical agents to identify those that inhibit the physiological functions of the protein.

Thus, in a further embodiment, an antagonist of the protein of SEQ ID NO: 249 can be administered to a subject to prevent or treat a disease associated with increased expression or activity of the protein. Similarly, in another embodiment a vector expressing the complement of a polynucleotide sequence encoding the protein of SEQ ID NO: 249 may be administered to decrease the expression of the protein.

The protein of SEQ ID NO: 249 displays a leucine zipper pattern situated near its NH2 terminal part (position 20 to 41). Thus, it is believed that the protein of SEQ ID NO: 249 is able to dimerize either with itself (homo-dimerisation) or with an heterologous protein (hetero-dimerisation) of interest, through the mediation of its leucine zipper domain. Preferred polypeptides of the invention are polypeptides comprising leucine zipper domains fragments and fragments having any of the biological activities described herein. The multimerization activity of the protein of the invention or part thereof may be assayed using any of the assays known to those skilled in the art including circular dichroism spectrum and thermal melting analyses as described in U.S. Pat. No. 5,942,433. The utilities of proteins containing leucine zipper domains, such as the protein of SEQ ID No: 249, are described elsewhere in the application.

Protein of SEQ ID NO: 259 (Internal Designation 114-016-1-0-H8-CS)

The protein of SEQ ID NO: 259, herein referred to as HOPP, is encoded by clone 114-016-1-0-H8-CS (SEQ ID NO: 18). This protein is homologous to a protein of *Arabidopsis thaliana* (ASY1) and *Saccharomyces cerevisiae*, (HOP1) (Caryl A. P. et al. Chromosoma, 109, 62–71; Hollingsworth N. M. et al. Cell, 61, 73–84).

In addition, the 394-amino-acid protein of SEQ ID NO: 259 displays a pfam HORMA domain from position 22 to 230. The HORMA domain is a common structural element in mitotic checkpoints, chromosome synapsis and DNA repair. For example, the HORMA domain was found in: (1) MAD2, a key component of the mitotic-spindle-assembly checkpoint (reviewed in Straiht A F. Current Biology 1997, 7:613–616); (2) HOP1, a conserved protein that is involved in meiotic-synaptonemal-complex assembly (Hollingsworth N. M. et al. Cell, 61, 73–84); and (3) in Rev7p, a subunit of the yeast DNA polymerase "epsilon" that is involved in translation, template independent DNA synthesis (Aravind L. and Koonin E. V., Trends Biochem Sci. 1998 August;23 (8):284–6).

The pairing of homologous chromosomes during meiotic prophase culminates in the formation of the synaptonemal complex (SC), which is a ribbon-like, proteinaceous structure that holds homologous chromosomes in close apposition along their entire length. The synaptonemal complex (SC) is a prominent and evolutionally well conserved structure which is strictly meiotic. Evidence from mutant phenotypes supports the hypothesis that recombination and SC formation are mutually interdependent processes. First, although not required for homology recognition, the SC could promote interhomolog interactions in situations where the normal processes have failed (e.g., interlocking, heterologous pairing, etc.). Second, polymerization of the SC components might permit the recombination process to progress by modulating the number and localization of reciprocal versus exchanges (i.e. interference). Third, the SC may play an important role in meiotic chromosome structure and especially inter-sister interactions.

Synapsis of homologous chromosomes is a key event in meiosis as it is essential for normal chromosome segregation and is implicated in the regulation of crossover frequency (for review see Zickler D., J Soc Biol 1999; 193(1):17–22). Mutants in HOP1 and ASY1, both proteins having significant homology to the protein of SEQ ID NO: 259, display decreased levels of meiotic crossover and intragenic recombination between markers on homologous chromosomes (Hollingsworth N. M., Byers B., Genetics 1989 March; 121(3):445–62; Caryl AP et al. Chromosoma 2000;109(1–2):62–71).

Thus, the invention relates to methods and compositions using the protein encoded by clone 114-016-1-0-II8-CS or polynucleotide of SEQ ID NO: 18, or biologically active fragments thereof, to restore normal chromosome segregation in cells by administration of compositions comprising HOPP polypeptide, or polynucleotide encoding a HOPP polypeptide, encoded by clone 114-016-1-0-H8-CS, or polynucleotide in therapeutically effective amounts. The loss of normal chromosome segregation in normal cells leads to aberrant chromosome segregation events, a hallmark of tumor progression. HOPP proteins, encoded by clone 114-016-1-0-H8-CS, can be targeted to the nucleus by nuclear targeting sequences according to well-known methods. Nuclear targeting sequences (or NLS) can be chemically or recombinantly attached to HOPP. Alternatively, the HOPP gene can be used in known gene therapy protocols to restore normal chromosome function.

Infertility due to gametogenic failure is frequently associated with structural autosomal abnormalities. Recent meiotic studies, at pachytene stage, have shown a failure around the breakpoints, an association of the translocation figure with the sex chromosomes, and the frequent involvement of the acrocentric chromosomes. Two main models are proposed to explain the male sterilizing effect of rearrangements. The impairment of spermatogenesis could be the result of: 1) the XY-autosome interaction; or 2) the disruption around the breakpoints at the pachytene stage. These defects may contribute significantly to germ-cell atresia (for review see Luciani J M, Guichaoua M R Reprod Nutr Dev 1990, Suppl 1:95s-103s and Miklos G L. Cytogenet Cell Genet. 1974; 13(6):558–15 77). Thus the subject invention also relates to methods and compositions of using the protein of SEQ ID NO: HOPP or clone 114-016-1-0-H8-CS, or biologically active fragments thereof, to reduce the incidence of infertility due to gametogenic failure. HOPP can be introduced into sperm as described in the preceding paragraphs. HOPP, optionally joined to a NLS sequence, can also be introduced into sperm or eggs by other methods well known in the art (such as electroporation or microinjection).

The protein of SEQ ID NO: 259, encoded by clone 114-016-1-0-H8-CS, can also arrest cell division in human cells if the mitotic spindle apparatus is improperly attached to the chromosomes (Allshire R. C. Current Opinion in Genetics and Development 1997, 7:264–273). In the absence of functional protein of SEQ ID NO: 259, cells exposed to drugs which inhibit the formation of a mitotic spindle, such as benomyl, vinblastine, nocodozole, etc. would be expected to undergo rapid cell death due to massive chromosome loss. Human cells containing HOPP would be expected to survive such drug treatment because they are able to stop dividing prior to the chromosome loss event. Tumor cells that are hypersensitive to chemotherapeutic agents, which inhibit the formation of the mitotic spindle, may be sensitive to these drugs because they are defective in the checkpoint protein. Thus, screening assays for the presence or absence of the protein in a given tumor would provide an indication of the chemosensitivity of a particular tumor. The present invention therefore includes methods of determining prognostic benefit of treating a patent with a chemotherapeutic agent or determining which chemotherapeutic agent from a group of at least two would a patient more likely benefit from. Furthermore, the loss of checkpoint function in a normal cell may predispose that cell to aberrant chromosome segregation events, a hallmark of tumor progression. Thus the antibodies, polypeptides and polynucleotides of the present invention would be useful in diagnosing particular cancers.

Polyclonal antibodies can be produced by injecting a host animal such as rabbit, rat, goat, mouse or other animal with an immunogen of this invention. The sera is extracted from the host animal and is screened to obtain polyclonal antibodies which are specific to the immunogen. Methods of screening for polyclonal antibodies are well known to those of ordinary skill in the art such as those disclosed in Harlow & Lane, Antibodies: A Laboratory Manual, (Cold Spring Harbor Laboratories, Cold Spring Harbor, N.Y.: 1988) the contents of which are hereby incorporated by reference.

The monoclonal antibodies can be produced by immunizing, for example, mice with an immunogen according to the invention. Methods of producing monoclonal antibodies are well-known in the art and include those methods Kohler, B. and Milstein, C., Nature (1975) 256: 495–497. Hybridomas can be expanded, if desired, and supernatants can be assayed by conventional immunoassay procedures, for example radioimmunoassay. Positive clones can be further characterized. Hybridomas that produce the desired antibodies can be grown in vitro or in vivo using known procedures. The monoclonal antibodies can be isolated by conventional immunoglobulin purification procedures such as ammonium sulfate precipitation, gel electrophoresis, dialysis, affinity chromatography, and ultra-filtration.

Antibodies of the invention can be labeled with a detectable moiety. As noted above, a "detectable moiety" is well known to those of ordinary skill in the art and include, but are not limited to, a fluorescent label, a radioactive atom, a paramagnetic ion, biotin, a chemiluminescent label or a label which can be detected through a secondary enzymatic or binding step.

The invention further provides a method of determining the susceptibility of a tumor sample to treatment with a mitotic spindle inhibitor which comprises steps of: a) contacting the tumor sample with an antibody, wherein the antibody is labeled with a detectable moiety and is capable of specifically binding to the protein of invention, or a fragment thereof, and b) assaying for the presence of an immunocomplex formed in step (a). The absence of the immunocomplex indicates that the tumor would be susceptible to treatment with a mitotic spindle inhibitor such as benomyl, vinblastine, and nocodozole.

The subject invention also provides a pharmaceutical composition comprising nucleic acid encoding the protein of SEQ ID NO: 259 and a carrier. In one aspect of this invention, the compositions are capable of passing through a cell membrane and provide for the expression of the protein of invention. As used herein, the term "carrier" includes pharmaceutically acceptable carriers and encompasses any of the standard pharmaceutically accepted carriers, such as phosphate buffered saline solution, water, emulsions such as an oil/water emulsion or a triglyceride emulsion, various types of wetting agents, tablets, coated tablets and capsules. carriers contain excipients such as starch, milk, sugar, certain types of clay, gelatin, stensic acid, talc, vegetable fats or oils, gums, glycols, or other known excipients. Flavor and color additives or other ingredients can also be included. In addition to the standard characteristics of the pharmaceutically acceptable carriers, the "suitable" carriers of the subject can also include those carriers which are able to penetrate the cell membrane. Therefore in one embodiment of the pharmaceutical composition the pharmaceutically acceptable carrier binds to a receptor on a cell capable of being taken up by the cell after binding to the structure.

This invention further provides a method of suppressing tumor formation in a subject which comprises administering a nucleic acid encoding the protein of invention in an amount effective to enhance expression of this protein.
Proteins of SEQ ID NOs: 311 and 312 (Internal Designation 188-28-4-0-B12-CS.corr and 188-28-4-0-B12-CS.fr respectively)

The 466-amino-acid-long protein of SEQ ID NO: 311, encoded by the human cDNA of clone 188-28-4-0-B12-CS or the cDNA nucleotide sequence of SEQ ID NO: 70, is related to proliferating-cell nucleolar antigen p120 (Genbank accession number M32110) encoded by nol1; and the yeast nucleolar protein Nop2p coded by nop2 (Genbank accession number U12141). SEQ ID NO: 311 (encoded by clone 188-28–4–0-B12-CS.corr) shows strong homology with three proteins described as homologs of p120 (Genbank accession number AK002229 and Geneseqp accession numbers: Y86441, Y86442). In addition, the protein of SEQ ID NO: 311 is a polymorphic variant of SEQ ID No: 312 encoded by the CDNA of SEQ ID No: 71.

In addition, the protein of the invention exhibits the pfam NOL1/NOP2/sun family signature from positions 201 to 276. This motif is also found by emotif from positions 230 to 245. The NOL1/NOP2/sun family include p120 and Nop2p. These proteins are involved in nucleolar structure and activity as well as the regulation of cell cycle.

Freeman J. W. et al. (Cancer Res. 48: 1244–51, 1988) identified p120, a 120-kD nucleolar antigen associated with proliferating cells. This protein is a proliferation-associated antigen that is temporally regulated during the cell cycle and demonstrates a dramatic increase in expression at the G1-S boundary. This suggests that p120 can play a role in the regulation of the cell cycle and the increased nucleolar activity that is associated with cell proliferation (Fonagy A. et al. (1993) J. Cell. Physiol. 154:16–27).

The human p120 protein is also the most cancer specific of the identified proliferation-associated nucleolar proteins. Antigen p120 was detectable in a broad range of human malignant tumors but not in benign tumors or corresponding normal tissues. The antigen was not detectable in growth-arrested cells but was expressed early in G1 of the cell cycle.

Overexpression of human p120 leads to the transformation of NIH 3T3 cells. Expression of antisense p120 constructs causes the p120-transformed cells to revert to their original phenotype. Perlaky L. et al. [Cancer Res. 52: 428–36 (1992)] and Valdez et al. [Cancer Res. 52: 5681–87

(1992)] reported that the middle region of antisense p120 RNA inhibited proliferation of NIH 3T3 cells to approximately the same extent as the full-length antisense construct. The predicted mouse and human P120 proteins are 63% identical.

Another protein of the Nol1/Nop2/Sun family, Nop2p, coded by the gene NOP2, has a role in nucleolar function during the onset of growth and in the maintenance of nucleolar structure (de Beus et al. (1994) J. Cell Biol. 127:1799–813). The two proteins, p120 and Nop2p, are associated to ribosomal RNA in pre-ribosomal particles and can mediate the maturation process of the ribosome (Hong B. et al. (1997) Mol. Cell Biol. 17:378–88; Gustafson W. C. et al. (1998) Biochem. J. 331:387–93).

The subject invention provides the polypeptides encoded by the human cDNA of clone 188-28-4-0-B12-CS and polynucleotide sequences encoding the same amino acid sequences. Also included in the invention are biologically active fragments of the protein encoded by the human cDNA of clone 188-28-4-0-B12-CS and polynucleotide sequences encoding these biologically active fragments. "Biologically active fragments" are defined as those peptide or polypeptide fragments having at least one of the biological functions of the full length protein (e.g., the ability to transform cell lines in vitro.).

The invention also provides variants of the protein of SEQ ID NO: 311, encoded by clone 15 188-28-4-0-B12-CS. These variants have at least about 80%, more preferably at least about 90%, and most preferably at least about 95% amino acid sequence identity to the amino acid sequence encoded by clone 188-28-4-0-B12-CS. Variants according to the subject invention also have at least one functional or structural characteristic of the protein encoded by clone 188-28-4-0-B12-CS. The invention also provides biologically active fragments of the variant proteins. Unless otherwise indicated, the methods disclosed herein can be practiced utilizing the protein encoded by clone 188-28-4-0-B12-CS, or clone 188-28-4-0-B12-CS, or variants thereof. Likewise, the methods of subject invention can be practiced using biologically active fragments of the protein encoded by clone 188-28-4-0-B132-CS, clone 188-28-4-0-B132-CS, or variants of said biologically active fragments.

Because of the redundancy of the genetic code, a variety of different DNA sequences can encode the amino acid sequence provided by clone 188-28-4-0-B12-CS. It is well within the skill of a person trained in the art to create these alternative DNA sequences encoding proteins having the same, or essentially the same, amino acid sequence. These variant DNA sequences are, thus, within the scope of the subject invention. As used herein, reference to "essentially the same" sequence refers to sequences that have amino acid substitutions, deletions, additions, or insertions that do not materially affect biological activity. Fragments retaining one or more characteristic biological activity of the protein encoded by clone 188-28-4-0-B12-CS are also included in this definition.

"Recombinant nucleotide variants" are alternate polynucleotides which encode a particular protein. They can be synthesized, for example, by making use of the "redundancy" in the genetic code. Various codon substitutions, such as the silent changes which produce specific restriction sites or codon usage-specific mutations, can be introduced to optimize cloning into a plasmid or viral vector or expression in a particular prokaryotic or eukaryotic host system, respectively.

In one aspect of the subject invention, SEQ ID NO: 311, encoded by clone 188-28-4-0-B12-CS, and variants thereof, can be used to generate polyclonal or monoclonal antibodies. Both biologically active and immunogenic fragments of the amino acid sequence or variant proteins can be used to produce antibodies. Polyclonal and/or monoclonal antibodies can be made according to methods well known to the skilled artisan. Antibodies produced in accordance with subject invention can be used in a variety of detection assays known to those skilled in the art. Another aspect of this invention provides monoclonal and polyclonal antibodies which do not cross-react with known p120 proteins.

In one embodiment, the protein encoded by clone 188-28-4-0-B12-CS, variants of said protein, and biologically active fragments of the protein or said variants can be used as a nucleolar-fraction marker in nuclear fractionation studies or as a marker of pre-ribosomal particles, in methods well known to the skilled artisan.

In another embodiment, the protein encoded by clone 188-28-4-0-B12-CS, variants of said proteins, and biologically active fragments thereof, can be used as a proliferation marker in neoplastic cells. Alternatively, quantitative immunoassays can be used to assess the levels of the protein in resected cancerous and normal tissues. Alternatively, levels of the protein encoded by clone 188-28-4-0-B12-CS can be compared between an individual and a "normal" control group as a prognostic indicator of malignancy. Further, the relationship between protein expression and cell proliferation can be assayed using cancer cell lines. Thus, the protein of the invention or part thereof can be used as a marker for proliferation in human cancer cells in vivo and in vitro. If the absence of expression of the protein of the invention on normal and benign tumors is confirmed, it could serve as a marker of malignant cancer cells. The proliferation rate of cancer cells can be also determined by quantitative analysis of the expression of the protein encoded by 188-28-4-0-B12-CS, or biologically active fragments thereof, according to methods described in Trere D. et al. (J. Pathol. 192:216–20, 2000).

The transforming activity of the protein of the invention can be assayed as described in Perlaky et al. (Anticancer Drug Des. 8:3–14, 1993). Thus, polynucleotides encoding the (188-28-4-0-B12-CS) protein can be used to induce transformation on NIH/3T3 cells in vitro. Alternatively, the polynucleotide encoding (188-28-4-0-B12-CS) can be used to provide antisense oligonucleotides useful in antisense therapeutic protocols according to methods known in the art. Protein of SEQ ID NO: 406 (Internal Designation 174-32-4-0-F8-CS)

The 378-amino-acid-long protein of SEQ ID NO: 406 encoded by the cDNA of SEQ ID NO: 165 is expressed in tissues such as colon, prostate and salivary glands and overexpressed in colon and prostate. The C-terminus of the protein of the invention is homologous to the human retinoblastoma-binding protein, RbAp48 (Qian Y W et al. (1993) Nature 364:648–652, GenBank accession number: X74262) and to its homologues conserved in other organisms including mouse (GenBank accession number: Q60972) and *C. elegans* (GenBank accession number: AF116530). The protein of the invention contains also two internal WD-repeat clusters (Prosite PS00678, amino acid positions 267 to 304 and positions 333 to 370, respectively), a structural motif involved in proteins interaction in signal transduction pathway and transcription regulation (Neer E J et al. (1994) Nature 371:297–300; Neer E J et al (1996) Cell 84:175–178).

The retinoblastoma protein (Rb) is the product of the retinoblastoma gene. Deletion or inactivation of both Rb alleles is essential in the formation of human retinoblastoma in both hereditary and sporadic forms (Benedict W F et al. (1983) Science 219: 973–975).

Loss-of-function mutations in the Rb gene is also found in many other tumor types, including osteosarcoma, breast carcinoma, small cell lung carcinoma, bladder carcinoma, prostate carcinoma and soft tissue sarcoma (Bookstein R et al. (1991) Crit. Rev. Oncog. 2:211-227). Introduction of the wild-type Rb gene into cultured retinoblastoma cells suppresses cells growth and their tumorigenicity in nude mice (Huang H J et al (1988) 242:1536–1566). Expression of normal Rb protein in prostate carcinoma, osteosarcoma, breast carcinoma and bladder carcinoma cells also suppresses their neoplastic phenotype, thus establishing the Rb gene as a tumor suppressor (Reviewed by Weinberg R A (1991) Science 254:1138–1146).

It has been shown that the Rb gene product is a nuclear phosphoprotein that undergoes cyclic phosphorylation and dephosphorylation during cell cycling. Rb is unphosphorylated or "underphosphorylated" during early G1 phase, and become phosphorylated just before S phase, and remains phosphorylated until late mitosis. Injection of unphosphorylated Rb protein into cell during early G1 phase inhibits the entry into S phase, suggesting that some of the growth suppressor functions of Rb may be carried out by the underphosphorylated form of Rb (Goodrich et al. (1991) Cell 67:293–302; Hinds P W et al. (1992) Cell 70:993–1006). Rb protein not only regulates cell cycle, but is also involved in cell differentiation. For example, lens epithelial cells in Rb-deficient mouse fail to terminally differentiate and undergo apoptosis (Morgenbesser et al. (1994) Nature 371:72–74).

It has been demonstrated that Rb protein inhibits cellular growth and proliferation through interactions with multiple cellular proteins that interfere with these cellular protein's downstream actions. For example, Rb protein is able to form specific complexes with transcriptional factor E2F, which regulates the expression of a set of genes essential for the G1 to S phase transition (Nevin J R et al (1992) Science 258:424429). The Rb protein restrains cell cycle progression by masking the E2F transactivation domain and by blocking the interaction of surrounding enhancer elements and basal transcription complex (Weintraub S J et al (1995) Nature 375:812–815). Association of Rb and UBF, a ribosomal transcription factor, results in suppression of the synthesis of ribosomal RNA by RNA polymerase I (Cavanaugh L I et al (1995) Nature 374:177–180; Mancini M et al (1994) Proc-.Natl.Acad.Sci.USA 91:418–422).

RbAp48 was first identified as a major protein from Hela cell that binds to a putative functional domain at the C-terminus of the Rb protein. Only unphosphorylated and hypophosphorylated forms of the Rb protein were coprecipitated with RbAp48. Like Rb protein, RbAp48 is a ubiquitously expressed nuclear protein that shares sequence homology with MSI1, a negative regulator of the Ras-cAMP pathway in the yeast *Saccharomyces cerevisiae*. Overexpression of RbAp48 can convert the yeast mutant strains from heat-shock sensitivity to heat-shock resistant, similar to the result obtained from MSI1 overexpression. Thus, the human RbAp48 is a functional homologue of MSI1 (Qian Y W et al. (1993) Nature 364:648–652).

Rbap48 protein was later found to be the p48 subunit of mammalian chromatin assembly factor 1 (CAF-1) and to be present in histone deacetylase complex (Parthum M R et al (1996) Cell 87:85–94). CAF-1 from human cell nuclei consists of three subunits of p150, p60 and p48 and is involved in assembling of histone3 and histone4 onto nascent nucleosome structure during DNA replication in S phase (Kaufman F D et al (1995) Cell 81:1105–1114). Indeed, some transcriptional repressors function through the recruitment of the histone deacetylase complex (HDAC), the latter acts by acetylating or deacetylating the tail protruding from the core histones, thereby modulating the local structure of chromatin (Reviewed by Pazin M J et al (1997) Cell 89:325–328). Rb protein recruits HDAC for binding to E2F to repress transcription (Brehm A et al (1998) Nature 391:597–601, Magnaghi-Jaulin L et al (1998) Nature 391:601–604). It was also reported that the p48 subunit of chicken CAF-1 can bind to chicken HDAC in vitro through interaction of WD40 repeats presented in both protein sequences (Ahmad A et al (1999) J.Biol.Chem. 274:16646–16653).

The WD-40 protein family is characterized by the repetition of a loosely conserved repeat of approximately 40 amino acids, each repeat being separated from each other by a Trp-Asp dipeptide sequence. The conserved core of this repeat, which usually ends with the amino acids Trp-Asp (WD), was first identified in the beta-subunit of the heterotrimeric GTP-binding protein, G-protein (Fong H et al. (1986) Proc.Natl.Acad.Sci.USA 83:2162–2166). Among the WD40 proteins identified to date, none are enzymes, and all seem to have regulatory functions (Neer, E. J. et al. (1994) Nature 371:297–300). A number of WD repeat proteins have been localized to the nucleus and function in the repression of transcription. These include Tup1, Hir1, and Met30 in *S. cerevisiae*; SCON2 in *Neurospora crassa*; extra sex combs and Groucho in *Drosophila*; COP1 in *Arabidopsis thaliana*; and HIRA and the family of TLE proteins in humans. These WD-40 proteins turn off a wide variety of genes, including those involved in segmentation, sex determination, and neurogenesis (controlled by Groucho) and those involved in photomorphogenesis (controlled by COP1). All of these WD40 containing proteins have been proposed to fold into propellers in which the internal beta-strands form a rigid skeleton that is fleshed out on the surface by specialized loops to which other proteins bind (Lambright D G et al (1996) Nature 379:311-319; Sondex J et al (1996) Nature 379:369-374).

Thus, discovery of new Rb-binding proteins is necessary to design methods of regulating cell growth and block tumorigenesis through the control of tumor suppressor proteins in their interaction with oncogene products and may provide new compositions which are useful in the diagnosis, prevention and treatment of cancer and developmental disorders.

It is believed that the protein of SEQ ID NO: 406 or part thereof plays a role in the control of gene expression, probably as a transcription repressor. The protein of the invention is thought to be able to bind to other proteins, preferably to nuclear proteins, more preferably to Rb. Preferred polypeptides of the invention are polypeptides comprising fragments of SEQ ID NO: 406 from position 159–373, 267–304 and 333–370. Other preferred polypeptides of the invention are polypeptides comprising fragments of SEQ ID NO: 406 having any of the biological activity described herein. The ability of the protein of the invention or part thereof to functions as a transcription repressor may be assessed using techniques well known to those skilled in the art including those described previously (Weintraub S J (1995) Nature 375:812–815; Qian Y W (1995) J.Biol.Chem. 270:25507–25513). The ability of the protein of the invention or part thereof, especially fragments containing WD-repeats, to bind to other proteins may be assessed using techniques well known to those skilled in the art including those described herein. For example, the protein of the invention could be used as a "bait" protein in a yeast double hybridization system (e.g. Gal4-based system from Clontech) to isolate and eventually to identify its interacting protein partner in vivo from a cDNA library. Alternatively, the protein of the invention or part thereof can be used either in a pure form or in a fusion form (linked to a reporter gene product, such as alkaline phosphatase) to screen a phage cDNA expression library derived from selected tissues or cell types of a given organism (Scott et al (1990) Science 249:386–390; Lam et al (1992) Nature 354:82–84). Preferably, the binding ability of protein of the invention is tested in mammalian cell transfection experiments. When fused in-frame to a suitable peptide tag in expression vector, such as $[His]_6$ in the pRset expression plasmid vector (Invitrogen) and introduced into culture cells, the proteins that bind to the expressed fusion protein can be immunoprecipitated using anti-$[His]_6$ antibody. This approach can also be employed to confirm the findings obtained from either yeast double hybridization system or in vitro phage peptide library screening. In this case, the putative interacting partner protein will be fused to a distinct tag in a second expression vector and co-transfected into culture cells. True binding complex will be co-immunoprecipitated with the two different anti-tag antibodies. In a particular embodiment, an affinity chromatography method is carried out to identify the interacting protein partners in vitro from cell lysates as performed for the identification of the RbAp48 protein (Qian YW et al. (1993) Nature 364:648–652).

An embodiment of the present invention relates to methods of using the protein of the invention or part thereof, particularly polypeptides containing WD-motifs, or derivative thereof to identify and/or quantify binding proteins, preferably nuclear proteins, more preferably Rb, in a biological sample, and thus used in assays and diagnostic kits for the quantification of such binding proteins in bodily fluids, in tissue samples, and in mammalian cell cultures. Such assays may be particularly useful as diagnostic or prognostic tools in the detection and monitoring of a disorder linked to dysregulation of expression of a transcription regulator. Such assays may thus be very useful to asses the level of the tumor suppressor Rb in disorders including but not limited to developmental disorders, cancers such as retinoblastoma, prostate carcinoma, osteosarcoma, breast carcinoma and bladder carcinoma. The binding activity of the protein of the invention or part thereof may be assessed using any method familiar to those skilled in the art. Preferably, a defined quantity of the protein of the invention or part thereof is added to the sample under conditions allowing the formation of a complex between the protein of the invention or part thereof and the binding protein to be identified and/or quantified. Then, the presence of the complex and/or or the free protein of the invention or part thereof is assayed and eventually compared to a control using any of the techniques known by those skilled in the art.

Another embodiment of the present invention relates to compositions and methods using the protein of the invention or part thereof or derivative thereof to block gene transcription either in vitro or in vivo. In a preferred embodiment, the protein of the invention or part thereof or derivative thereof is added in an effective amount to an in vitro culture to inhibit gene expression and thus cell proliferation using molecular biology techniques known to those skilled in the art allowing the import of the protein from the extracellular medium to the cell's nucleus. In another embodiment, eukaryotic cells are genetically engineered in order to express the protein of the invention or part thereof under specific conditions in order to prevent further proliferation of such cells upon demand such as infection, transformation, activation, differentiation, end of a production process.

A preferred embodiment of the invention relates to compositions or methods using SEQ ID NO: 406, SEQ ID NO: 165 or part thereof to diagnose, treat and/or prevent disorders including but not limited to disorders linked to dysregulation of gene transcription such as cancers and other disorders relating to abnormal cellular differentiation, proliferation, or degeneration, including hyperaldosteronism, hypocortisolism (Addison's disease), hyperthyroidism (Grave's disease), hypothyroidism, colorectal polyps, gastritis, gastric and duodenal ulcers, ulcerative colitis, and Crohn's disease; metabolic diseases such as obesity and a number of inflammatory diseases due to interleukin over-expression. For diagnostic and prognostic purposes, the expression of the protein of the invention could be investigated using any of the Northern blotting, RT-PCR or immunoblotting methods described herein and compared to the expression in control individuals. For prevention and/or treatment purposes, the protein of the invention may be overexpressed using any of the gene therapy methods known to those skilled in the art including those described herein. For example, expression of the protein of the invention can be upregulated by infecting tumor cells with a retroviral or an adenoviral vector which expresses the desired protein at higher levels necessary for suppression of mutation in the Rb gene or in other oncogenic or tumor suppressor genes.

Another related embodiment relates to the use of SEQ ID NO: 406, SEQ ID NO: 165, its complement, or any part thereof to develop antagonists of the protein of the invention. These antagonists could be antisense oligonucleotides, triple helices, ribozymes, small molecules or antibodies, especially neutralizing antibodies binding to the WD-repeats of the invention, and may be used to treat disease and conditions caused by abnormally low transcription. These conditions include accelerated aging syndromes such as Cochayne's syndrome, Ataxia telangiectasia and Werner's syndrome as well as age-associated diseases as well as "early onset" forms of diseases associated with old age such as dementia and Parkinson's disease.

In another embodiment, the invention relates to methods and compositions using the protein of the invention or part thereof as a marker protein to selectively identify tissues, preferably colon and prostate. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

Protein of SEQ ID NO: 414 (Internal Designation 188-27-3-0-G1-CS)

The 389 amino-acid long protein of SEQ ID NO: 414, expressed in brain, fetal brain, placenta and testis, overexpressed in brain and encoded by the cDNA of SEQ ID NO: 173 is homologous to SIRTUIN-2 (SIRT2) (Trembl accession number: Q9Y6E9) and Silent Information Regulator 2-like protein (SIR2L) (Trembl accession number: Q9UNT0) that belong to the Silent Information Regulator type 2 (SIR2) family. In addition, the protein of the invention presents the Pfam signature for members of the SIR2 family (amino acids 84–268). Furthermore, the protein of the invention displays two characteristic motifs highly conserved among all members of the SIR 2 family that have been shown to be essential in the SIR2 silencing function (Moira M. et al., Genetics, 154:1069–1083 (2000)). These motifs are from positions 84 to 98 and from positions 165 to 170 of the protein of SEQ ID NO: 414 and correspond to GAG(I/V)SxxxG(I/V)PDFERS and (Y/I)TQNID patterns respectively. The protein of SEQ ID NO: 414 also has conserved cysteines residues at positions 195, 200, 221 and 224, covering a domain thought to be either a DNA-binding zinc-finger motif (Prodom prediction PD002659, from positions 195 to 224) or an enzymatic domain (or an enzyme cofactor) (Moira M. et al., Genetics, 154:1069–1083 (2000)).

The cDNA of SEQ ID NO: 173 encoding the protein of the invention differs from the one encoding the SIRT2 protein by a supplementary exon between positions 147 to 195. This exon modifies the initiation codon of the protein and extends the ORF in its N-terminal part by 16 amino acids. Moreover, amino residues in positions 20 and 21 of the protein of the invention (respectively an alanine and a glutamine residue) are substituted from a glutamine and a tyrosine residue (positions 4 and 5) of the SIRT2 protein. Thus, the protein of the invention is a new isoform of SIR2 resulting from alternative splicing. The protein of the invention of SEQ ID NO: 414 is also 37 amino acids longer than the SIRL2 protein at its N-terminal end.

Regulation of gene expression by alterations in chromatin structure is a universal mechanism in eukaryotic cells, responsible for maintaining patterns of gene expression throughout the development of multicellular organisms. Silencing has been studied most extensively in S. cerevisae (yeast). Among the SIR genes, SIR2 is the most evolutionarily conserved, and a number of genes with homology to SIR2 have been identified (Frye R et al., Biochem. Biophys. Res. Commun., 273:793–798 (2000)). Presence of Homologues of SIR2 (HSTs) in organisms from bacteria to humans suggests that SIR2's silencing mechanism might be conserved. SIR2 was originally discovered to influence mating-type control in haploid cells by locus-specific transcriptional silencing. It has also been suggested that SIR2 and its homologs play additional roles in suppression of recombination, chromosomal stability, metabolic regulation, meiosis, and aging (for a review: see Gartenberg, Curr. Opin. Microbiol. 3:132–137 (2000)).

Proteins of the SIR2 family are also thought to be either enzymes or enzyme cofactors. First, Landry and collaborators have shown that members of SIR2 family catalyze histone deacetylation in a reaction that requires NAD, thereby distinguishing them from previously characterized deacetylases. This enzyme is active on histone substrates that have been acetylated by both chromatin assembly-linked and transcription related acetyltransferases (Landry et al., Proc. Natl. Acad. Sci. 97:5807–5811 (2000)). Discovery of an intrinsic deacetylation activity for the conserved SIR2 family provides a mechanism for modifying histones and other proteins to regulate transcription and diverse biological process. Secondly, the study of a human SIR2 family member (hSirT2) was found to have a mono-ADP ribosylation activity in vitro (Frye R et al., Biochem. Biophys. Res. Commun., 260: 273–279 (1999)). Among potential substrates for mono-ADP ribosylation are histones and RNA Pol I, modification of which correlates with enhanced rDNA transcription.

It is believed that the protein of SEQ ID NO: 414 or part thereof plays a role in gene silencing, suppression of recombination, chromosomal stability, metabolic regulation, meiosis, and aging, probably as a member of the SIR2 protein family. Particularly, the protein of the invention may deacetylate substrates, preferably acetylated histones and acetyltransferases, either directly or indirectly as enzyme cofactors. Particularly, the protein of the invention may have a ribosylation activity, preferably a mono-ADP ribosylation activity, preferably on histones and RNA Pol I substrates, either directly or indirectly as enzyme cofactors. Additionally, the protein of the invention may be a DNA binding protein. Preferred polypeptides of the invention are polypeptides comprising the amino acids of SEQ ID NO: 414 from positions 1 to 16, 84 to 98, 165 to 170, 195 to 224, and 84–268 as well as fragments of SEQ ID NO: 414 containing at least one cysteine residues located in positions 195, 200, 221 or 224 of SEQ ID NO: 414. Other preferred polypeptides of the invention are fragments of SEQ ID NO: 414 having any of the biological activities described herein. The deacetylation activity of the protein of the invention or part thereof may be assayed using any of the assays known to those skilled in the art including those described in Laundry et al., supra. The ribosylation activity of the protein of the invention or part thereof may be assayed using any of the assays known to those skilled in the art including those described in Frye et al, (1999). The nucleic acid binding activity of the protein of the invention or part thereof may be assayed using any of the assays known to those skilled in the art including those described in U.S. Pat. No. 6,013,453.

The invention relates to methods and compositions using the protein of the invention or part thereof to silence gene expression. In a preferred embodiment, the protein of the invention or part thereof or derivative thereof is added in an effective amount to an in vitro culture to inhibit gene expression and thus cell proliferation using molecular biology techniques known to those skilled in the art allowing the import of the protein from the extracellular medium to the cell's nucleus. In another embodiment, eukaryotic cells are genetically engineered in order to express the protein of the invention or part thereof under specific conditions in order to prevent further proliferation of such cells upon demand such as infection, transformation, end of a production process, differentiation, etc.

The invention relates to methods and compositions using the protein of the invention or part thereof to deacetylate substrates, alone or in combination with other substances. Such substrates are acetylated substrates, preferably acetylated histones and acetyltransferases. For example, the protein of the invention or part thereof is added to a sample containing the substrate(s) in conditions allowing deacetylation, and allowed to catalyze the deacetylation of the substrate(s). In a preferred embodiment, the deacetylation is carried out using a standard assay such as those described in Laundry et al, supra. Deacetylated histones obtained by this method may be mixed with purified naked DNA (plasmid preparations for example) in order to reconstitute chromatine-like structures in vitro. Such structures are of great interest in the study of enzymatic factors involved in transcription and replication.

Another embodiment of the present invention relates to composition and methods of using the protein of the invention or part thereof to develop assays for in vitro screening of inhibitors directed against the encoded deacetylase activity using any technique known to those skilled in the art including those described herein. Such deacetylase inhibitors are of great potential as new drugs due to their ability to influence transcriptional regulation and to induce apoptosis or differentiation in cancer cells. Preferably, the protein of the invention, expressed in prokaryotic or eukaryotic systems according to methods known to those skilled in the art, may be mixed in vitro with a simple fluorescent substrate like an aminocoumarin derivative of an acetylated lysine, and different putative inhibitors. The coumarin derivative is then quantitated using a reverse-phase HPLC-system with a fluorescence detector. Such an approach has been previously developed by Hoffmann and collaborators (Hoffmann et al., Nucl. Acids Res. 27:2057–2058 (1999); Hoffmann et al., Pharmazie 55:601–606 (2000)).

The invention relates to methods and compositions using the protein of the invention or part thereof to bind to nucleic acids, preferably DNA, alone or in combination with other substances. For example, the protein of the invention or part thereof is added to a sample containing nucleic acid in conditions allowing binding, and allowed to bind to nucleic acids. In a preferred embodiment, the protein of the invention or part thereof may be used to purify nucleic acids such as restriction fragments. In another preferred embodiment, the protein of the invention or part thereof may be used to visualize nucleic acids when the polypeptide is linked to an appropriate fusion partner, or is detected by probing with an antibody. Alternatively, the protein of the invention or part thereof may be bound to a chromatographic support, either alone or in combination with other DNA binding proteins, using techniques well known in the art, to form an affinity chromatography column. A sample containing nucleic acids to purify is run through the column. Immobilizing the protein of the invention or part thereof on a support advantageous is particularly for those embodiments in which the method is to be practiced on a commercial scale. This immobilization facilitates the removal of the protein from the batch of product and subsequent reuse of the protein. Immobilization of the protein of the invention or part thereof can be accomplished, for example, by inserting a cellulose-binding domain in the protein. One of skill in the art will understand that other methods of immobilization could also be used and are described in the available literature.

Still another embodiment of the present invention relates to composition and methods of using the protein of the invention or part thereof to identify genes or regions of the human genome silenced by the protein of the invention or part thereof. Genomic DNA derived from patients with pathologies such as cancer and metabolic disorders, or from elderly people may be compared to those extracted from respective controls for their ability to bind the protein of the invention. As described previously, the protein of SEQ ID NO: 414 displays a putative zinc finger domain susceptible to bind DNA sequences near regions or genes to silence. The protein of the invention or part thereof may be bound to a chromatographic support, using techniques well known in the art, to form an affinity chromatography column. A sample containing a mixture of human genomic DNA digested by endorestriction enzymes is run through the column. After extensive washings the bound DNA is eluted and further subcloned in classical cloning vectors known to those skilled in the art. Immobilizing the protein of the invention or part thereof on a support is particularly advantageous for those embodiments in which the method has to be practiced routinely. This immobilization facilitates the removal of DNAs from the batch of resin coupled protein after binding, and allows subsequent re-use of the protein. Immobilization of the protein of the invention or part thereof can be accomplished, for example, by inserting any matrix-binding domain in the protein according to methods known to those skilled in the art. The resulting fusion product including the protein of the invention or part thereof is then covalently, or by any other means, bound to a protein, carbohydrate or matrix (such as gold, "Sephadex" particles, and polymeric surfaces).

Another embodiment of the invention relates to methods of preparing antibodies directed against the protein of the invention or part thereof. Such antibodies may be used in co-immunoprecipitation procedures that enrich for chromatin fragments containing binding sites for the protein of the invention. This method may identify genes or regions of the human genome silenced by the deacetylase activity of the protein of the invention. Preferably, in samples containing fragments of native chromatin, antibodies directed against 414 and coupled to protein A or protein G sepharose beads are added to the mixture. Immunoprecipitation conditions are those known to those skilled in the art. After washings DNA fragments co-precipitated with 414 are extracted and further subcloned in routinely used cloning vectors. These DNA fragments are either sequenced and/or used as probes to screen genomic libraries. This procedure is very similar to the one used by Gould and collaborators to enriche for embryonic chromatin fragments containing sites for the homeotic Ubx protein (Gould et al., Nature 348:308–312 (1990)).

A preferred embodiment of the invention relates to compositions or methods using SEQ ID NO: 414, SEQ ID NO: 173 or part thereof to diagnose, treat and/or prevent develop disorders caused by the expression of "disease causing" genes. The number of pathologies and conditions that could be treated by the protein of the invention is potentially huge and unlimited. Favored disorders linked to dysregulation of gene transcription such as cancer and other disorders relating to abnormal cellular differentiation, proliferation, or degeneration, including hyperaldosteronism, hypocortisolism (Addison's disease), hyperthyroidism (Grave's disease), hypothyroidism, colorectal polyps, gastritis, gastric and duodenal ulcers, ulcerative colitis, and Crohn's disease; viral infection especially HIV and viral hepatitis (i.e. expression of viral proteins), metabolic diseases such as obesity and a number of inflammatory diseases due to interleukin over-expression. For diagnostic purposes, the expression of the protein of the invention could be investigated using any of the Northern blotting, RT-PCR or immunoblotting methods described herein and compared to the expression in control individuals. For prevention and/or treatment purposes, the protein of the invention may be overexpressed using any of the gene therapy methods known to those skilled in the art including those described herein. For example, switching off "disease" genes may be achieved by, for example, directly targeting the protein of the invention or part thereof to the genes (such as oncogenes in cancers) that are over-expressed in order to silence their expression. This could be achieved by making a "chimera" protein in which the putative zinc-binding domain is replaced by a sequence known to bind to, or near the over-expressed gene as explained elsewhere in the application. Fusion proteins containing both the deacetylase activity and the specific DNA binding domain are obtained by methods of molecular biology well known to those skilled in the art. The corresponding eukaryotic expression vectors may be use in gene therapy in the cases of cancer, metabolic disorders, aging and any disorder where a gene is over-expressed. Such recombinant cDNA may be introduced in the well-known adenoviral vectors used in cancer therapy (for a recent review on the use of replicative adenoviruses for cancer therapy: Alemany et al., Nat. Biotechnol. 18:723–727 (2000)).

Another related embodiment relates to the use of SEQ ID NO: 414, SEQ ID NO: 173, its complement, or any part thereof to develop antagonists of the protein of the invention and of the SIR complex. These antagonists could be antisense oligonucleotides, triple helices, ribozymes, small molecules or antibodies and may be used to treat disease and conditions caused by abnormal gene silencing. These conditions include accelerated aging syndromes such as Cochayne's syndrome, Ataxia telangiectasia and Werner's syndrome as well as age-associated diseases as well as "early onset" forms of diseases associated with old age such as dementia and Parkinson's disease.

In another embodiment, the invention relates to methods and compositions using the protein of the invention or part thereof as a marker protein to selectively identify tissues, preferably brain tissues. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

Protein of SEQ ID NO:298 (182-1-2-0-D12-CS)

The protein of SEQ ID NO:298, encoded by the cDNA of SEQ ID NO: 57, is homologous to proteins of the fibroblast growth factor family (FGF). Specifically the amino acid sequence of SEQ ID NO:298 is identical to the recently described FGF-23. The protein of the invention is strongly expressed in the fetal liver.

The protein of the invention presents the pfam signature for fibroblast growth factors (positions 48 to 129). High resolution X-ray structures of crystals of both FGF-1 and FGF-2 have been reported and reveal a "beta trefoil" topology, comprising 12 strands linked to form a three-fold symmetrical structure made up of four-stranded antiparallel beta sheet (see Faham S. et al.—Curr Opin Struct Biol.—1998, 8(5): p578–586). On the basis of sequence conservation, it seems very likely that all members of the FGF family have related 3-dimesional structures. Preferred polypeptides of the invention are those that comprise amino acids 39 to 45; 51 to 56; 60 to 64; 71 to 77; 82 to 87; 92 to 97; 101 to 105; 113 to 119; 124 to 130; 142 to 147; 151 to 155 and/or 167 to 172, which by homology with other members of the FGF family make up the 12 beta pleated sheets characteristic of the FGF family (White K. et al.—Nat Genet.—2000; 26(3): pp. 345–348). Furthermore, as within these regions a number of amino acids from SEQ ID NO:298 are conserved in over 80% of human FGFs (after sequence alignment), the most preferred polypeptides of the invention comprise amino acids 42, 53, 63, 83, 85, 87, 93, 96, 101, 113, 115, 124, 127 and/or 129. Other preferred polypeptides of the invention are any fragment of SEQ ID NO:298 having any of the biological activities described herein.

The protein of SEQ ID NO:298 is a member of the fibroblast growth factor family, and is thus involved in a number of cellular and organismal proesses, including, but not limited to, cell growth and differentiation, angiogenesis, morphogenesis, wound healing, cell survival, replication, adhesion and mobility.

One embodiment of the present invention relates to the use of the present polypeptides and polynucleotides to identify liver, heart, thyroid and parathyroid tissues, or cells derived from these tissues, since the protein of the invention is expressed therein (White K. et al.—Nat Genet.—2000; 26(3): p345–348). Such detection of cells expressing the protein can be carried out in any of a number of ways, including the use of specific antibodies or antiserum generated against the protein using standard methods, as well as using polynucleotide probes specific for nucleic acids encoding the protein of the invention.

In another embodiment, the protein of the invention or part thereof can be used as a mitogen to stimulate the growth of a number of different cells types including, but not limited to, fibroblasts, osteoblasts, keratinocytes and hepatocytes. The growth of cells can be stimulated in vitro, for example to promote the growth of cells cultured for the synthesis of recombinant proteins, or for ex vivo gene therapy applications. Another preferred application of this technique relates to the use of the protein of the invention or part thereof to generate in vitro tissues and organs including, but not limited to, skin, cartilage, and bone for transplants and grafts (Lancet—1981, 1(8211):75–8)).

The protein of the invention can be administered to treat pathologies and conditions that result from damage to cells, tissues or organs. These pathologies and conditions include but are not limited to bone fractures and bone defects Kimoto et al.—J Dent Res—1998, 77(12): p1965–1969) (Solheim E—Int Orthop—1998, 22(6), damage due to wounds (such as lesions of the skin and ulcers) (Debus E.—Zentralbl Chir—2000, 125 (supple 1): p49–55) (Szabo S.—Aliment Pharmacol Ther—2000, 14(Suppl 1): p33–43), tissue damage due to ischemia (for example, in the brain and heart) (Simons M. —Circulation—2000, 102(11): pE73-E86), cardiovascular diseases such as thrombosis and atherosclerosis (Bauters C.—Drugs—1999, 58 (Spec No 1): p11-15) and neurodegenerative diseases due to neuronal loss such as Parkinson's disease or Alzheimer's disease (Ebadi M—Neurochem Int—1997, 30(4–5): p347–374) (Brundin P.—Cell Transplant—2000, 9(2): p179–195).

In a most preferred embodiment, the polypeptides or polynucleotides of the invention can be used to diagnose, treat, or prevent disorders resulting from non-functional and/or mutated FGFs, such as Autosomal dominant hypophosphataemic rickets, which is associated with mutation of certain amino acids of FGF-23 (White K. et al.—Nat Genet.—2000; 26(3): p345–348, which is hereby incorporated by reference in its entity. Such disorders can be treated, for example, by administering a therapeutically effective amount of the protein of the invention or a polynucleotide sequence encoding the protein to a patient suffering from the disorder. Similarly, SEQ ID NO:298 or SEQ ID NO:57 or any part thereof can be used to develop diagnostic kits in order to diagnose, prevent and/or treat any other disease associated with FGF, for example pathologies associated with FGF overexpression.

In yet another embodiment, the protein of the invention or part thereof can be used to develop antagonists of FGF and/or FGF receptors in order to treat disorders associated with an over-activation of FGF pathways (for example, due to over production of FGF or overstimulation of FGF receptors). This is particularly true for pathologies such as cancers where some tumors secrete large quantities of FGF, such as prostate and breast cancers. Furthermore FGF antagonists can be useful in inhibiting tumor angiogenesis, which is an essential step in tumor growth. In the same way SEQ ID NO:57 or any part thereof could be used to generate antisense oligonucleotides. Antisense oligonucleotides block complementary mRNA, thus inhibiting the synthesis of the protein encoded by the mRNA. These oligonucleotides can be used in in vivo or ex vivo treatment of the diseases caused or aggravated by overexpression of FGFs.

Protein of SEQ ID No: 396 (Internal Designation: 160-12-1-0-D10-CS)

The protein of SEQ ID No: 396 encoded by the cDNA of SEQ ID No: 155, overexpressed in brain and fetal brain, shows homology to memebers of the transmembrane 4 super family of proteins (TM4SF). The protein of the invention displays signatures characteristic of this family, namely the pfam domain from positions 66 to 273, the Prosite motif from positions 112 to 134 as well as the emotif domains from positions 108 to 127, 108 to 146, 129 to 150, 128 to 154, and 247 to 274. In addition, the protein of the invention has several predicted transmembrane domains: 103 to 123, 130 to 150 and 245 to 265, with an additional predicted domain with lower certainty from positions 61 to 81. The protein of the invention has significant homology to a TM4SF member, the integral membrane CD81 antigen also known as TAPA1 (Target of Antiproliferative Antibody), except for its N-terminus. The transmembrane domains of the protein of the invention matches those described for CD81.

Members of the tetraspan family of proteins are associated with adhesion molecules and translate adhesive events into a regulation of cellular behaviour. TAPA-1 is a widely expressed protein found to influence adhesion, morphology, activation, proliferation and differentiation of B, T and other cells. TAPA-1 has two long hydrophilic domains of the molecule which are extracellular and located between four TM (Transmembrane region, TM1–4). The region between TM2 and TM3 is highly conserved in all tetraspanins. The protein is highly hydrophobic and contains a potential N-myristoylation site. TAPA1 functions by forming a complex on the cell surface and the antigenic epitope of the human TAPA1 is contained within a subregion of the second extracellular domain of the protein. Cell-surface expression of TAPA1 can be down-modulated by binding of antibodies (Levy 1991, J Biol Chem Aug 5;266(22):14597–602).

Mice lacking CD81 (not expressing TAPA1) have impaired antibody responses to protein antigens. This defect is specific to antigens that preferentially stimulate a T helper 2 response and is only seen with T cell-dependent antigens. Absence of CD81 on B cells is sufficient to cause the defect. Antigen-specific interleukin (IL) 4 production is greatly reduced in the spleen and lymph nodes of CD81-null mice compared with heterozygous littermates. The expression of CD81 on B cells is critical for inducing optimal IL-4 and antibody production during T helper 2 responses. CD81 is likely to have a greater role in the control of immune responses than in the development of immune cells (Maecker (1997) J Exp Med 1997 Apr. 21;185(8):1505–10). CD81 on B cells has the capacity to promote IL-4 secretion from T cells. Costimulatory proteins such as B7–1 and B7–2 have been shown in some systems to have differential effects on cytokine secretion by T cells. CD81 on B cells, can control cytokine production by T cells. TAPA-1 has been implicated to play an important role in the regulation of lymphoma cell growth.

TAPA-1 is highly expressed in many neurons of the brainstem. TAPA is found in all glial cells, and the level of this protein correlates with their maturation (Sullivan et al., 1998, J Comp Neurol 1998 Jul. 6;396(3):366–80). This protein is expressed by ependyma, choroid plexus, astrocytes, and oligodendrocytes. TAPA1 is dramatically upregulated during early postnatal development, at the time of glial birth and maturation. At embryonic day 18, the levels of TAPA are low, with most of the immunoreaction product being associated with the ependyma, choroid plexus, and the glia limitans. The amount of TAPA expressed in the brain increases with brain development, and at postnatal day 14 the protein levels approach those of the adult. This increase in the levels of TAPA at postnatal day 14 is due to upregulation in the gray matter and white matter. TAPA has been associated with reactive gliosis and the glial scar. The spatiotemporal expression pattern of CD81 by reactive microglia and astrocytes indicates that CD81 is involved in the glial response to spinal cord injury. It is suggested that the upregulation of TAPA is an integral component of glial scar formation (Peduzzi et al, Exp Neurol. 1999 December;160(2):460–8).

The levels of TAPA-1 are low in metastatic prostate tumors, expression of this protein in these cells appears to suppress metastatic behavior (Dong et al., 1995 Science. 12;268(5212):884–6.). Bivalent antibodies directed against these proteins can be used to enhance adhesion of different cell types: pre-B cells (Masellis-Smith and Shaw (1994) J Immunol 1994 Mar. 15;152(6):2768–77), endothelial cells (Forsyth, 1991 Immunology February;72(2):292–6), and tumor cell mobility and invasiveness (Miyake et al., 1991 J Exp Med. Dec. 1;174(6):1347–54.). In the nervous system, the migratory behavior of Schwann cells over biologically relevant substrates can be enhanced with the application of antibodies directed against certain TM (Anton et al (1995) J Neurosci. Jan.;15(1 Pt 2):584–95). Antibodies directed against TAPA-1 depress the mitotic activity and induce an increase in cellular adhesion (Oren et al, 1990 Mol Cell Biol Aug.; 10(8):4007–15).

The protein of SEQ ID NO: 396 or part thereof plays a role in cell adhesion, motility, metastasis, cell activation, signal transduction and the immune response, probably as a member of the TM4SF family. As a member of the tetraspanin family of proteins, the protein of SEQ ID No: 396 or part there of is believed to mediate cellular interaction in lymphoid cells as well as non-hematolymphoid tissue to affect cell adhesion and migration, alter cell morphology and the activation slate of a cell. Preferred polypeptides of the invention are polypeptides comprising the amino acids of SEQ ID NO: 396 from positions 66 to 273, 112 to 134, 108 to 127, 108 to 146, 129 to 150, 128 to 154, and 247 to 274. Other preferred polypeptides of the invention are fragments of SEQ ID NO: 396 having any of the biological activity described herein. The activity of the protein of the invention or part thereof may be assayed using any of the assays known to those skilled in the art including those describing a functional tissue assay used to define surface antigens regulating astrocyte growth (Eldon et al, 1996, J Neurosci, 16(17):5478); cellular function assays determining the involvment of the protein in signal transduction and cell adhesion in the immune system (Levy et al, 1998 Ann. Rev. Immunol. 16:89–109, Virtaneva et al, 1994 Immunogenetics 39: 329–334).

An embodiment of the present invention relates to methods of using the protein of the invention or part thereof to identify and/or quantify membrane proteins, preferably integrins, lineage specific molecules, tetraspanins, and antibodies, in a biological sample, and thus used in assays and diagnostic kits for the quantification of such membrane proteins in tissue sample, and in mammalian cell cultures. The binding activity of the protein of the invention or part thereof may be assessed using the assay described in Shoshana et al, 1998, Annu. Rev. Immunol 16: 89–109; Maecker et al, 1998 PNAS 95: 2458–2462; Geisert et al, 1996, J of Neuroscience 16(17): 5478–5487 or any other method familiar to those skilled in the art. Preferably, a defined quantity of the protein of the invention or part thereof is added to the sample under conditions allowing the formation of a complex between the protein of the invention or part thereof and the membrane protein to be identified and/or quantified. Then, the presence of the complex and/or or the free protein of the invention or part thereof is assayed and eventually compared to a control using any of the techniques known by those skilled in the art.

In another embodiment, the invention relates to compositions and methods using the protein of the invention or part thereof to stimulate cell proliferation, preferably proliferation of lymphoid cells both in vitro and in vivo. For example, soluble forms of the protein of the invention or part thereof may be added to cell culture medium in an amount effective to stimulate cell proliferation.

In another embodiment, the invention relates to compositions and methods using the protein of the invention or part thereof or derivative thereof to stimulate antibody production either in vitro or in vivo. In a preferred embodiment, the protein of the invention or part thereof or derivative thereof may be added in an effective amount to stimulate antibody production to an in vitro culture of antibody-producing cells, such as hybridomas. In another preferred embodiment, the protein of the invention or part thereof or derivative thereof may be injected into an animal in order to increase the animal's antibody production to a protein of interest in the case of production of polyclonal antibodies.

In still another embodiment, the invention relates to compositions and methods using the protein of the invention or part thereof or derivative thereof to decrease cell adhesion either in vitro or in vivo. In a preferred embodiment, the protein of the invention or part thereof or derivative thereof may be added in an effective amount to prevent and/or inhibit cell adhesion to an in vitro culture of adherent cells in order to recover those adherent cells.

In still another embodiment, the invention relates to compositions and methods using the protein of the invention or part thereof to treat and/or prevent cell-proliferative disorders, such as cancers, via the prevention of metastasis preferably brain cancer, and disorders characterized by depressed immune response such as autoimmune diseases AIDS, allergy, type1 diabetes, systemic lupus erythematosus, chronic rheumatoid arthritis, juvenile rheumatoid arthritis, Sjogren's syndrome, systemic scleriasis, mixed connective tissue disease and dermatomyositis, Hashimoto's disease, primary myxedema, thyrotoxia, pernicious anemia, ulcerative colitis, autoimmune atrophic gastritis, idiopathic Addison's disease, male infertility, Goodpasture's syndrome, acute progressive glomerular nephritis, myasthenia gravis, multiple myositis, pemphigus vulgaris, bullous pemphigoid, sympathetic ophthalmia, multiple sclerosis, autoimmune hemolytic anemia, idiopathic thrombocytopenic purpura, postmyocardial infarction syndrome, rheumatic fever, lupoid hepatitis, primary biliary cirrhosis, Behcet's syndrome and Crest's syndrome, via the stimulation of antibody production and IL-4 secretion.

In another embodiment, the invention relates to methods and compositions using the protein of the invention or part thereof as a marker protein to selectively identify tissues, preferably from brain and fetal brain origin. For example, the protein of the invention or part may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry or any other technique known to those skilled in the art.

Protein of SEQ ID No: 296 (Internal Designation 181-3-3-0-B8-CS)

The protein of SEQ ID NO: 296 encoded by the cDNA of SEQ ID NO:55, overexpressed in fetal liver, is homologous to the whole domain IV-4 and IV-5 of the basement membrane-specific heparan sulfate proteoglycan core protein (perlecan), well conserved among *C.elegans*, mice and human (accession numbers Q06561, Q05793 and P98160 respectively). The 247-amino-acid-long protein of the invention, displays two putative hydrophobic stretches from positions 44 to 64 and 219 to 239 and a putative immunoglobulin domain from positions 141 to 197, homolog to the Ig domain 4 of the Ig repeat structure of domain IV of perlecan proteins. The protein of the invention displays also a putative secreted signal peptide from positions 6 to 21.

Basement membranes are specialized regions of extracellular matrix (ECM) containing a large number of different components, including laminin, collagen, nidogen and heparan sulfate proteoglycans (for a review see Bernfield at al., Annu. Rev. Biochem. 68:729–777 (1999)). Perlecan, a major basement membrane, plays important roles in many fundamental development and regenerative processes, including cell cohesion, adhesion and migration, signal transduction, and even gene regulation (Martin and Timpl, Annu. Rev. Cell Biol. 3:57–85 (1987)). The cDNA sequence of perlecan encodes a large core protein consisting of five structural domains, referred from I to V, with distinct motifs such as SEA modules (domain I), LDL class A modules (domain II), cysteine-rich LE modules (domain III), LAMB modules (domain V). Domain IV consists of Ig-like repeats (14 in mice, 21 in human perlecan) similar to those of neural cell adhesion molecules (N-CAMs). Glycosaminoglycan chains are mostly linked to domain I and have been shown to participate with the core protein in its differential expression in tissues and development stages (Perrimon and Bernfield, Nature 404:725–728 (2000)).

The N-terminal fragment IV containing Ig modules from 1 to 8 show high-affinity binding to the two known nidogen isoforms, laminin1-nidogen1 complex (LN) and binding to heparin at physiological ionic strength (Hopf et al., Eur. J. Biochem. 259:917–925(1999)). An alteration study of the *C. elegans* perlecan show in vivo that mutations in Ig-like modules 3 and 4 induce a lethal phenotype by inhibiting the spatial distribution of the splice variants. Mutations inducing deletions in other Ig-like modules of perlecan domain IV does neither affect the isoform expression nor the spatial distribution, suggesting a crucial role of Ig-like modules 3 and 4 in muscle assembly and development stages (Mullen et al., Mol. Biol Cell 10:3205–3221 (1999)).

Several studies have shown the large presence of distinct perlecan isoforms through regulated alternative splicing in *C. elegans* (Rogalski et al, Genes Dev. 7:1471–1484 (1993), Rogalski et al, Genetics139:159–169(1995)). Although splice variants have not yet been shown in human, Ig-like modules are encoded by multiple exons compatible with different combinatorial possibilities of expression (Cohen et al., P.N.A.S. 90:10404–10408 (1993)). Alternative splicing within Domain IV is associated with temporal and spatial differences in isoform expression. A subset of *C.elegans* isoforms are associated with body-wall muscles during embryogenesis and are required for nematode myofilament lattice assembly, which is very similar to assembly of focal adhesions in mammalian cell culture (Moerman and Fire, CSH labo. Press (1997)).

Basement membrane-like structure containing perlecan, collagen IV, laminin also plays a major role during liver differentiation by interacting with immature hepatocytes (Am. J. Path. 142:199–208 (1993)).

Perlecan have been implicated in a number of processes and diseases resulting from the alteration of its structure including glomerular filtration deficiencies such as proteinuria, diabetic glomerulopathies, nephrotic syndromes, Denys-Drash syndromes (Groffen at al., Nephrol. Dial. Transplant 14:2119–2129 (1999)), mitogenesis and angiogenesis diseases (Aviezer et al., Cell 79:1005–1013 (1994)), inflammation and tissue repair, ocular and skeletal defect syndromes, microbial pathogenesis through invasion. Perlecan core protein has binding epitopes for the basement membrane proteins nidogen-1, nidogen-2, and fibulin-2, as well as for Alzheimer's beta-amyloid protein (Snow et al., Arch. Biochem. Biophys. 320:84–95 (1995)), and platelet growth factor.

It is believed that protein of SEQ ID NO: 296 or part thereof is a membrane basement-like protein, preferably a human isoform of the perlecan protein. Thus, the protein of the invention plays an important role in membrane integrity and interactions with other basement proteins and particularly with nidogen-1 and 2, LN complexes and heparin coumpounds. Besides, the protein of the invention is thought to participate in the interactions with cellular receptors such as integrins, with cytokine release and proteolysis, with regulation of angiogenesis, wound healing and tumor invasion. Being overexpressed in the fetal liver, the protein of the invention is thought to participate in the differentiation, migration and adhesion of hepatocytes trought its spatial and temporal expression during embryogenesis. Preferred polypeptides of the invention are polypeptides comprising the amino acids of SEQ ID NO: 296 from positions 141 to 197. Other preferred polypeptides of the invention are fragments of SEQ ID NO: 296 having any of the biological activity described herein. The activity of the protein of the invention or part thereof may be assayed using any of the assays known to those skilled in the art including those described in Hopf et al., Euro. J. Biochem. 259:917–925 (1999) for binding assays with other membrane proteins, and in Rescan et al., Am. J. Path. 142:199–208 (1993) for protein assays (Immunochemistry and ELISA).

In one embodiment, the invention relates to methods and compositions using the protein of the invention or part thereof as a new marker protein to selectively identify embryogenic stages, preferably in liver tissues. For example, the protein of the invention or part thereof may be detected using specific antibodies able to bind to the protein using any technique known to those skilled in the art. Such tissue-specific antibodies may then be used to identify embryogenic cells with dysregulaed membrane components such as in differentiated tumor cells or to differentiate different cell types in a tissue cross-section using immunochemistry. For example, the amount of the protein of the invention in embryogenic cells reflecting the characterized overexpression activity is measured and compared to that of a normal cell using a specific antibody detected by fluorescence (FACS, confocal microscopy, . . . ) or ay other detection methods skilled in the art.

In another embodiment the invention relates to methods and compositions using the protein of the invention or part thereof for the diagnosis of a disorder associated with overexpression of the protein of the invention, preferably but not limited to perlecan associated tumors such as human melanoma, proliferative diseases, glomerular filtration deficiencies such as proteinuria, diabetic glomerulopathies, nephrotic syndromes, Denys-Drash syndromes, mitogenesis and angiogenesis diseases, inflammation and tissue repair, ocular and skeletal defect syndromes, microbial pathogenesis through invasion. The expression of the protein of the invention could be investigated using any methods well known to those skilled in the art, including Northern blotting, RT-PCR or immunoblotting using specific antibodies binding to the protein of the invention.

In still another embodiment the protein of the invention or part thereof could be used as a mitogen to stimulate the growth and differentiation of a number of different cells types including but not limited to fibroblasts, muscle cells, osteoblasts, keratinocytes and hepatocytes. In a preferred embodiment, the protein of the invention or part thereof is used in in vitro cultures such as those used for synthesis of recombinant proteins. The protein of the invention or part thereof is added to the culture in an amount effective to stimulate proliferation and/or differentiation. A more preferred application of this technique relates to the use of the protein of the invention or part thereof in generating or reparing in vitro tissues and organs such as but not limited to skin, cartilage, and bone for transplants and grafts (Lancet—1981, 1(8211):75–8), which disclosure is hereby incorporated by reference in its entirety).

In another embodiment, an antagonist of the protein of SEQ ID NO:296 may be administered to a subject to treat or prevent a cell proliferative disorder. Such disorders may include, but are not limited to, arteriosclerosis, atherosclerosis, bursitis, cirrhosis, hepatitis, mixed connective tissue disease (MCTD), myelofibrosis, paroxysmal nocturnal hemoglobinuria, polycythemia vera, psoriasis, primary thrombocythemia, and cancers including adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus. In one aspect, an antibody which specifically binds to the protein of the invention may be used directly as an antagonist or indirectly as a targeting or delivery mechanism for bringing a pharmaceutical agent to cells or tissue which express the protein of the invention. In another example, antisense nucleotides, triple helices, Genetic Suppressor Elements (GSE), ribozymes designed from nucleotides encoding the protein of the invention or part thereof using any methods to those skilled in the art are administered to inhibit the expression of the protein of the invention.

Protein of SEQ ID NO: 410 (Internal Designation 179-9-4-0-B8-CS)

The protein of SEQ ID NO: 410 encoded by cDNA of SEQ ID NO: 169 found in fetal kidney is homologous to the proteins of ankyrin family protein and the proteins containing a characteristic ankyrin repeated motif (pfam accession number: PF00023). The protein of the invention shows homology with human ankyrin proteins (PIR accession number A35049; SP-TREMBL accession number: Q99407)), ankyrins from several different eucaryote species (*Drosophila melanogaster*: STR accession number Q9VAU5; mouse: STR accession number Q61302 and SwissProt accession number Q02357; cow: STR accession number AAF61702; *Arabidopsis thaliana*: STR accession number Q9ZQ79) and ankyrins from procaryote species (*Paramecium bursaria Chlorella* virus: STR accession number STR Q41164).

In addition, the protein of the invention shows homology with other proteins containing ankyrin repeat motif. The ankyrin repeat motif is a 33 amino acid motif and has an L-shaped structure consisting of two alpha helices following the beta hairpin loop (Gorina et al., Science.274–1005 (1996)). Examples of proteins comprising ankyrin repeats include: channels, enzymes toxins, transcription factors (Palek et al., Semin. Hematol. 27:290–332 (1990)), tankyrase (Smith et al., Science.282:1484–1487 (1998)), multiple proteins involved in signal transduction, in particular integrin-linked kinases (Huang et al., Int. Mol. Med.

3:563–572 (1999)), inhibitors of cyclin-dependent kinases (Baumgartner et al., Structure. 6:1279–1290 (1998)), death-associated protein kinase involved in apoptosis (Raveh et al., Proc. Nath. Acad. USA. 15:1572–1577 (2000)) and many others. *JL*

The ankyrin motif is also found in the protein of the invention (position 47 to 79).

Ankyrins are peripheral membrane proteins which have been found in erythrocyte, kidney and neuronal cells of mammals. Cells contain a cytoskeleton that links intracellular compartments with each other and the plasma membrane. Associations between the cytoskeleton and the lipid membranes bounding these compartments involve spectrin, ankyrin, and integral membrane proteins. Spectrin is a major component of the cytoskeleton and acts as a scaffolding protein. Similarly, ankyrin acts to tether the actin-spectrin moiety to membranes and to regulate the interaction between the cytoskeleton and membranous compartments. Different ankyrin isoforms are specific to different organelles and provide specificity for this interaction. Genes coding for three different mammalian ankyrins (ankyrin$_R$, ankyrin$_B$ and ankyrin$_G$) have been cloned. Ankyrin$_R$ was originally identified as part of the erythrocyte membrane skeleton, and was recently also localized to the plasma membrane of a subpopulation of post mitotic neurons in rat brain (Lambert, et al., 1993, J. Neurosci., 13, 3725–3735). Ankyrin$_B$ is a developmentally regulated human brain protein which has two alternatively spliced isoforms with molecular masses of 220 kilodaltons (kD) and 440 kD (Kunimoto, et al., 1991, J. Cell Biology, 115, 1319–1331). Ankyrin$_G$ is a more recently isolated human gene that encodes two neural-specific ankyrin variants (480 kD and 270 kD), which have been localized to the axonal initial segment and node of Ranvier (Kordeli, et al., 1995, J. Biol. Chem., 270, 2352–2359). Studies on mammalian ankyrins indicate that ankyrins bind a variety of proteins which have functions involved with the anion exchanger (Drenckhahn, et al., 1988, Science, 230, 1287–1289), Na+/K+-ATPase, amiloride-sensitive sodium channel in kidney (Smith, et al., 1991, Proc. Natl. Acad. Sci. U.S.A., 88, 6971–6975), voltage dependent sodium channel of the brain and the neuromuscularjunction (Srinivasan, et al., 1988, Nature, 333, 177–180), and nervous system cell adhesion molecules (Davis, et al., 1994, J. Biol. Chem., 269, 27163–27166).

Analyses of mammalian ankyrins have revealed that these large proteins are divided into three functional domains. These include an N-terminal membrane-binding domain of about 89–95 kD, a spectrin-binding domain of about 62 kD, and a C-terminal regulatory domain of about 50–55 kD. The membrane binding domain is primarily comprised of tandem repeats of about 33 amino acids each. This domain usually has about 22–24 copies of these repeats. The repeat units appear to function in binding to membrane proteins such as anion exchangers, sodium channels, and certain adhesion molecules. The spectrin-binding domain, as the name implies, functions in binding to the spectrin-based cytoskeleton of cells positioned inside the plasma membrane. Finally, the regulatory domain, which is the most variant domain among the different ankyrins that have been studied, appears to function in as a repressor and/or an activator of the protein-binding activities of the other two domains. Some of the variability seen in this domain among different ankyrin species appears to be the result of alternative splicing of nascent transcripts. The regulatory domain can respond to cellular signals, allowing remodeling of the cytoskeleton during the cell cycle and differentiation (Lambert, S. and Bennett, V. (1993) Eur. J. Biochem. 211:1–6). Ankyrin may be target for action of parasites. Erythrocyte ankyrin is cleaved by parasite proteases of plasmodium falciparum destabilizing erythrocyte membrane skeleton which facilitates parasite release (Raphael et al., Mol Biochem Parasitol. 110(2):259–272 (2000)). Recently, novel ankyrin proteins have been isolated from *Dirofilaria* and *Brugia* which may be useful in protecting animals, including humans, from diseases caused by parasitic helminths (U.S. Pat. No. 6,063,599).

Ankyrin sequences have been identified in various libraries, at least 50% of which are associated with cancer and at least 23% of which are associated with the immune response. Of particular note is the expression of ANFP in reproductive and hematopoietic/immune, and gastrointestinal tissues. See U.S. Pat. No. 5,989,863.

It is believed that the protein of SEQ. ID. NO: 410 is a member of the family of human ankyrin proteins and as such plays a role in regulating the interaction between the cytoskeleton and membranous components. The identification of a new member of the ankyrin family and the polynucleotides encoding it addresses a need in the art by providing new compositions which are useful in the diagnosis, prevention, and treatment of autoimmune/inflammatory, cell proliferative, vesicle trafficking disorders and in modulating the response to infectious diseases.

Preferred polypeptides of the invention are polypeptides comprising the amino acids from positions 47 to 79. Other preferred polypeptides are fragments of SEQ. ID. NO: 410 having the desired biological activity. Further included in the invention are the polypeptides encoded by the human cDNA of clone 179-9-4-0-B8-CS. The polypeptides of SEQ ID NO: 410 may be interchanged with the corresponding polypeptides encoded by the human cDNA of clone 179-9-4-0-B8-CS. Further included in the invention are polynucleotides encoding said polypeptides. Preferred polynucleotides are those of SEQ ID NO: 169 and of the human cDNA of clone 179-9-4-0-B8-CS.

The invention also encompasses variants of the protein of the invention. A preferred variant is one which has at least about 80%, more preferably at least about 90%, and most preferably at least about 95% amino acid sequence identity to the amino acid sequence of SEQ. ID. NO: 410, and which contains at least one functional or structural characteristic of ankyrin.

In a particular embodiment, the invention encompasses a polynucleotide sequence comprising the sequence of SEQ ID NO: 410, as well as variants of that sequence. Variants which encode at least one functional region characteristic of the ankyrin protein of the present invention are encompassed. Codon usage may be varied according to standard techniques in order to enhance expression in various hosts.

In one embodiment, the protein of SEQ. ID. NO: 410 or a fragment or derivative thereof may be administered to a subject to treat or prevent a disorder associated with decreased expression or activity of ankyrin. Examples of such disorders include, but are not limited to, autoimmune/inflammatory disorders such as acquired immunodeficiency syndrome (AIDS), Addison's disease, adult respiratory distress syndrome, allergies, ankylosing spondylitis, amyloidosis, anemia, asthma, atherosclerosis. autoimmune hemolytic anemia, autoimmune thyroiditis, autoimmune polyenodocrinopathy-candidiasis-ectodermal dystrophy (APECED), bronchitis, cholecystitis, contact dermatitis, Crohn's disease, atopic dermatitis, dermatomyositis, diabetes mellitus, emphysema, episodic lymphopenia with lymphocytotoxins, erythroblastosis fetalis, erythema nodosum, atrophic gastritis, glomerulonephritis, Goodpasture's syndrome, gout, Graves' disease, Hashimoto's thyroiditis, hypereosinophilia, irritable bowel syndrome, multiple sclerosis, myasthenia gravis, myocardial or pericardial inflammation, osteoarthritis, osteoporosis, pancreatitis, polymyositis, psoriasis, Reiter's syndrome, rheumatoid arthritis, scleroderma, Sjogren's syndrome, systemic anaphylaxis, systemic lupus erythematosus, systemic sclerosis, thrombocytopenic purpura, ulcerative colitis, uveitis, Werner syndrome, complications of cancer, hemodialysis, and extracorporeal circulation, viral, bacterial, fungal, parasitic, protozoal, and helminthic infections, and trauma; cell proliferative disorders such as actinic keratosis, arteriosclerosis, bursitis, cirrhosis, hepatitis, mixed connective tissue disease (MCTD), myelofibrosis, paroxysmal nocturnal hemoglobinuria, polycythemia vera, psoriasis, primary thrombocythemia, and cancers including adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus; and vesicle trafficking disorders such as cystic fibrosis, glucose-galactose malabsorption syndrome, hypercholesterolemia, diabetes mellitus, diabetes insipidus, hyper- and hypoglycemia, Grave's disease, goiter, and Cushing's disease, ulcerative colitis, and gastric and duodenal ulcers.

In another embodiment, a vector capable of expressing the protein of SEQ. ID. NO: 410 or a fragment or derivative thereof may be administered to a subject to treat or prevent a disorder associated with decreased expression or activity of ankyrin including, but not limited to, those described above.

In a further embodiment, a pharmaceutical composition comprising a substantially purified protein of SEQ. ID. NO. 410 or a portion of the protein in conjunction with a suitable pharmaceutical carrier may be administered to a subject to treat or prevent a disorder associated with decreased expression or activity of the same or a similar protein including, but not limited to, those provided above.

In still another embodiment, an agonist of the protein of SEQ. ID. NO. 410 which modulates the activity of the protein may be administered to a subject to treat or prevent a disorder associated with decreased expression or activity of the protein, or other ankyrin proteins, including, but not limited to, those listed above.

In another embodiment, the polypeptide of SEQ. ID. NO. 410 may be used to produce antagonists using methods which are generally known in the art. In particular, purified polypeptide may be used to produce antibodies or to screen libraries of pharmaceutical agents to identify those which specifically bind ankyrin proteins. Neutralizing antibodies (i.e., those which inhibit dimer formation) can also be prepared for therapeutic use.

In a further embodiment, an antagonist of the protein of SEQ. ID. NO. 410 may be administered to a subject to treat or prevent a disorder associated with increased expression or activity of the same protein or other members of the ankyrin family of proteins. Such disorders may include, but are not limited to, those discussed above. In one aspect, an antibody which specifically binds the claimed polypeptide may be used directly as an antagonist or indirectly as a targeting or delivery mechanism for bringing a pharmaceutical agent to cells or tissue which express the polypeptide.

In an additional embodiment, a vector expressing the complement of the polynucleotide of SEQ. ID. NO. 169 may be administered to a subject to treat or prevent a disorder associated with increased expression or activity of ankyrin proteins including, but not limited to, those described above.

In other embodiments, any of the proteins, antagonists, antibodies, agonists, complementary sequences, or vectors of the invention may be administered in combination with other appropriate therapeutic agents. The combination of therapeutic agents may act synergistically to effect the treatment or prevention of the various disorders described above. Using this approach, one may be able to achieve therapeutic efficacy with lower dosages of each agent, thus reducing the potential for adverse side effects.

In another embodiment of the invention, the polynucleotides encoding the polypeptide of SEQ. ID. NO. 410, or any fragment or complement thereof, may be used for therapeutic purposes. In one aspect, the complement of the polynucleotide encoding the above-identified polypeptide may be used in situations in which it would be desirable to block the transcription of the mRNA. In particular, cells may be transformed with sequences complementary to polynucleotides encoding the polypeptide. Thus, complementary molecules or fragments may be used to modulate the activity of the claimed polypeptide or related ankyrin proteins, or to achieve regulation of gene function.

In another embodiment of the invention, the nucleotide sequence encoding the polypeptide of SEQ. ID. NO. 410 can be used to turn off the genes expressing the polynucleotide or related ankyrin proteins. In particular, a cell or tissue can be transformed with expression vectors which express high levels of the polynucleotide, or fragment thereof. Such constructs may be used to introduce untranslatable sense or antisense sequences into the cell. Expression vectors derived from retroviruses, adenoviruses, or herpes or vaccinia viruses, or from various bacterial plasmids, may be used for delivery of the nucleotide sequences to a targeted organ, tissue, or cell population.

An additional embodiment of the invention relates to the administration of a pharmaceutical or sterile composition, in conjunction with a pharmaceutically acceptable carrier, for any of the therapeutic effects discussed above. The composition may be delivered via a variety of different routes.

In another embodiment, antibodies which bind the polypeptide of SEQ. ID. NO. 410 may be used for the diagnosis of disorders characterized by expression of ANFP, or in assays to monitor patients being treated with the polypeptide, other ankyrin proteins or agonists, antagonists, or inhibitors of the same. A variety of assay types, including ELISAs, RIAs, and FACS, can be used.

In another embodiment of the invention, the polynucleotide of SEQ. ID. NO. 169 itself, may be used for diagnostic purposes. The polynucleotide can be used to generate oligonucleotide sequences, complementary RNA and DNA molecules, and PNAs which are useful in diagnosis. The polynucleotide and related molecules may be used to detect and quantitate gene expression in biopsied tissues in which expression of the polypeptide of SEQ. ID. NO. 410 or other ankyrin polypeptides may be correlated with disease. The diagnostic assay may be used to determine absence, presence, and excess expression of the polypeptides, and to monitor regulation of polypeptide levels during therapeutic intervention. Examples of diagnostic methods include Southern or Northern analysis, dot blot, or other membrane-based technologies; in PCR technologies; in dipstick, pin, and multiformat ELISA-like assays; and in microarrays utilizing fluids or tissues from patients to detect altered ANFP expression. Such qualitative or quantitative methods are well known in the art. Such assays may also be used to evaluate the efficacy of a particular therapeutic treatment regimen in animal studies, in clinical trials, or to monitor the treatment of an individual patient. In further embodiments, oligonucleotides or longer fragments derived from any of the polynucleotide sequences described herein may be used as targets in a microarray. The microarray can be used to monitor the expression level of large numbers of genes simultaneously and to identify genetic variants, mutations, and polymorphisms. This information may be used to determine gene function, to understand the genetic basis of a disorder, to diagnose a disorder, and to develop and monitor the activities of therapeutic agents.

In another aspect of the invention, the polypeptide may be used to stimulate the expression of genes that have a role in organ and organ system development. Thus, in a preferred embodiment, the protein of the invention, a fragment, or derivative thereof, may be administered to a subject to treat or prevent developmental disorders.

In a further embodiment, the protein of the invention may be administered to a subject to treat or prevent a cardiovascular disorder. Such disorders can include, but are not limited to, arteriosclerosis including atherosclerosis and nonatheromatus arteriosclerosis, hypertension, stroke, coronary artery disease, ischemia, myocardial infarction, angina pectoris, cardiac arrhythmias, sinoatrial node blocks, atrioventricular node blocks, chronic hemodynamic overload, aneurysm, Jervell and Lange-Nielsen syndrome, and long QT syndrome. The protein of the invention may also be used as a marquer of cardiac hypertrophy so it may be included in diagnosis kit for this disease.

In another embodiment of the invention, the polypeptide and/or polynucleotide may be used to inhibit cellular proliferation and to treat and/or diagnose disorders associated with cellular proliferation including but not limited to cancer.

In a further embodiment of the invention, an antagonist of the protein of the invention may be administered to a subject to treat or prevent a cancer. In one aspect, an antibody which specifically binds the protein of the invention may be used directly as an antagonist or indirectly as a targeting or delivery mechanism for bringing a pharmaceutical agent to cells or tissue which express the protein of the invention.

In yet another embodiment, an antagonist of the protein of the invention may be administered to a subject to treat or prevent a neuronal disorder. Such a disorder may include, but is not limited to, akathesia, Alzheimer's disease, amnesia, amyotrophic lateral sclerosis, bipolar disorder, catatonia, cerebral neoplasms, dementia, depression, diabetic neuropathy, Down's syndrome, tardive dyskinesia, dystonias, epilepsy, Huntington's disease, peripheral neuropathy, multiple sclerosis, neurofibromatosis, Parkinson's disease, paranoid psychoses, postherpetic neuralgia, schizophrenia, and Tourette's disorder. In one aspect, an antibody which specifically binds the protein of the invention may be used directly as an antagonist or indirectly as a targeting or delivery mechanism for bringing a pharmaceutical agent to cells or tissue which express the protein of the invention.

In another embodiment, the protein of the invention can be administered to a subject to treat or prevent a malaria. The protein of the invention may be used also in diagnosis of malaria.

In yet another embodiment, the polynucleotide and/or the polypeptide of the present invention can be used as a therapeutic composition capable of protecting an animal from a disease caused by a parasitic helminth. The polypeptide can be used a target for antiparasitic vaccines and drugs.

Ankyrin has been shown to underlie membrane proteins including CD44, the voltage-dependent sodium channel, NA+/K+ ATPase and the anion exchanger protein. It is believed that the formation of a direct connection between ankyrin and functionally important transmembrane proteins/membrane skeleton may be one of the earliest events to occur during signal transduction and cell activation. Thus, in a further embodiment, the polypeptide of the present invention can be used to disrupt the connection between ankyrin and the membrane thus affecting fundamental processes within the cell.

The polypeptide of the present invention can be further used to screen for compounds that inhibit or enhance the binding of ankyrin binding proteins and to affect the association between ankyrin and proteins, such as Alpha-Na,K-ATPase, which are critical to intracellular transport of ions and nutrients.

In yet another embodiment the regulatory domain of the polypeptide of SEQ. ID. NO. 410 or antagonists thereof can be used to enhance or disrupt the protein binding activities of the other domains.

Proteins of SEQ ID NOs: 385 and 416 (Internal Designations 105-021-3-0-C3-CS and 188-31-1-0-E6-CS respectively)

The 354 amino acids protein of SEQ ID NO: 385 encoded by the cDNA of SEQ ID NO: 144 found in brain displays 6 kelch motifs (pfam accession number PF01344) at positions 20–66, 68–114, 116-162, 164–209, 211-265 and 270–316. Morevoer, 4 residues conserved in over 90% of kelch family sequences are found in the protein of invention: di-glycine at positions 133–134, tyrosine 148 and tryptophan 155. In addition, six residues separate the tyrosine 148 and the tryptophan 155: this feature is conserved in over 70% of kelch proteins (Adams et al., trends in cell biology, 10:17–24, 2000). The proteins of the invention encoded by the cDNA of SEQ ID NO: 144 is a polymorphic variant of the protein of SEQ ID NO: 416 encoded by the cDNA of SEQ ID NO: 175, thought to have the same functions and utilities.

*Drosophila* kelch is located in the ring canals which are actin-rich bridges. Kelch localizes to the rim of preformed canals and serves to maintain actin organization (Xue et al., Cell (72)681–693, 1993; Robinson et al., J. Cell Biol. (138)799–810, 1997). In mammalian sperm, calicin is located within an actin-negative structure termed the calyx, which is involved in the morphogenesis of the spermatocyte (von Bulow et al., Exp. Cell Res. (219)407–413, 1995). Calcin and a well-structured calyx are both lacking in certain teratozoospermias, possibly indicating a central role for calicin in the organization of this structre (Courtot et al., Mol. Reprod. Dev. (28)272–279, 1991). In *Schizosaccharomyces pombe*, Ral2p acts down-stream of Ras1p in pathways that affect cell morphology, conjugation and sporulation. The spherical morphology and mating defects of ral2-null cells are complemented by overxpression of Ras1p, indicating a close functional interaction between the two proteins (Fukui et al., Mol. Cell. Biol. (9)5617–5622, 1989). The transcription factor Nrf2 is sequestered by the kelch-repeat containing Keap1 protein under normal cellular conditions. The stimulation by agents such as diethylmaleate induces the translocation of Nrf2 to the nucleus to initiate the cytoprotective electrophilic counterattack response (Itoh et al., Genes Dev. (13)76–86, 1999). Lytic infection of cells by herpes simplex virus is initiated by binding of virally encoded VP16 to HCF-1, a protein thought to have a normal role in cell-cycle progression. The HCF-VP16 complex then assembles with Oct-1 transcription factor on cis-regulatory targets in the HSV genome to initiate virus replication. (Wilson et al., Mol. Cell. Biol (17)6139–6146, 1997; Hughes et al., J. Biol. Chem. (274)16437–16443, 1999). Two recently discovered mammalian kelch-repeat proteins have extracellular roles. Human attractin appears to participate in normal immune defence as a serum glycoprotein released by activated T cells. In coculture assays, attractin stimulates adhesion and spreading of monocytes, facilitating the development of T-cell clusters and cellular immune responses (Duke-Cohan et al., Proc. Natl. Acad. Sci. U.S.A. (95)11336–11341, 1998). Attractin is orthologous to the extracellular domain of mouse mahogany, a large, multidomain, transmembrane protein that has been implicated in the homeostasis of energy metabolism by its suppressive effects on certain types of obesity in mice (Gunn et al., Nature (398)152–156, 1999; Nagle et al., Nature (398) 148–152, 1999).

Evidence for the importance of kelch repeat beta-propellers in protein function has also come from studies of natural an engineered loss-of-function mutations. *Caenorhabditis elegans* Spe-26 mutant spermatocytes fail to complete meiosis, contain multiple nuclei and show gross disorganization of actin filaments and organelles. For five out of the six alleles that have been examined in detail, the mutations map within the kelch repeats (Varkey et al., Genes Dev. (9)1074–1086, 1995). Of particular interest are the point mutations in RAG-2 that have been identified in some cases of human B-cell-negative severe combined immunodeficiency or of Omenn syndrome (Schwarz et al., Science (274)97–99, 1996; Villa et al., Cell (93)885–896, 1998). Very recently, the gigaxonin, a new member of the cytoskeletal BTB/kelch repeat family, is described as mutated in giant axonal neuropathy (Bomont et al., Nat. Genet. (26) 370–374, 2000).

It is believed that the proteins of the invention are members of the kelch superfamily and, such as, play a role in the association with the actin cytoskeleton, the organization of cytoskeletal, plasma membrane or organelle structures, the coordination of morphology and growth, the gene expression, the viral pathogenesis, the immune defence. In particular, the proteins of invention are highly expressed in brain and is believed to be related to the CNS disorders. Preferred polypeptides of the invention are polypetides comprising the amino acids of the proteins of invention at positions 20–66, 68–114, 116-162, 164–209, 211-265 and 270–316. In one embodiment, the proteins of the invention or part thereof are used to modulate actin organization in cells thus affecting the cytoskeleton and cell function in general.

The invention also features compounds, e.g., proteins, which interact with the protein of the invention. Any method suitable for detecting protein-protein interactions may be employed for identifying transmembrane proteins, intracellular, or extracellular proteins that interact with the protein. Among the traditional methods which may be employed are co-immunoprecipitation, crosslinking and co-purification through gradients or chromatographic columns of cell lysates, or proteins obtained from cell lysates, and the use of the proteins of the invention to identify proteins in the lysate that interact with it. For these assays, the protein of the invention can be full length or some other suitable protein polypeptide fragment. Once isolated, such an interacting protein can be identified and cloned and then used, in conjunction with standard techniques, to identify proteins with which it interacts. For example, at least a portion of the amino acid sequence of a protein which interacts with the protein of the invention can be ascertained using techniques well known to those of skill in the art, such as via the Edman degradation technique. The amino acid sequence obtained may be used as a guide for the generation of oligonucleotide mixtures that can be used to screen for gene sequences encoding the interacting protein. Screening may be accomplished, for example, by standard hybridization or PCR techniques. Techniques for the generation of oligonucleotide mixtures and the screening are well-known. ("PCR Protocols: A Guide to Methods and Applications," Innis et al., eds. Academic Press, Inc., NY, 1990).

Additionally, methods can be employed which result directly in the identification of genes which encode proteins that interact with the protein of the invention. These methods include, for example, screening expression libraries, in a manner similar to the well known technique of antibody probing of lambda.gt11 libraries, using labeled polypeptide or a protein fusion protein, e.g., a protein polypeptide or domain fused to a marker such as an enzyme, fluorescent dye, a luminescent protein, or to an IgFc domain.

Another embodiment of the invention relates to compositions and methods using the protein of the invention or part thereof to modulate actin organization and related cytoskeletal protein organization in cells and in particular, cells of the CNS. Compositions containing the protein of the invention and fragments thereof may be therapeutic and used to treat a variety of neuronal disorders. An additional embodiment of the invention relates to the administration of a pharmaceutical or sterile composition, in conjunction with a pharmaceutically acceptable carrier, for any of the therapeutic effects discussed. The composition may be delivered via a variety of different routes.

In yet another embodiment, an antagonist of the protein of the invention may be administered to a subject to treat or prevent a neuronal disorder. Such a disorder may include, but is not limited to, akathesia, Alzheimer's disease, amnesia, amyotrophic lateral sclerosis, bipolar disorder, catatonia, cerebral neoplasms, dementia, depression, diabetic neuropathy, Down's syndrome, tardive dyskinesia, dystonias, epilepsy, Huntington's disease, peripheral neuropathy, multiple sclerosis, neurofibromatosis, Parkinson's disease, paranoid psychoses, postherpetic neuralgia, schizophrenia, and Tourette's disorder. In one aspect, an antibody which specifically binds the protein of the invention may be used directly as an antagonist or indirectly as a targeting or delivery mechanism for bringing a pharmaceutical agent to cells or tissue which express the protein of the invention.

Another embodiment of the invention encompasses DNA sequences which encode the proteins of the invention that may be derived through biological or synthetic chemistry processes. Polynucleotides sequences capable of hybridizing to the cDNA sequences of SEQ ID NOs: 144 and 175 are also included in the scope of the invention.

Further included in the invention are the polypeptides encoded by the human cDNA of clones 105-021-3-0-C3-CS and 188-31-1-0-E6-CS. The polypeptides of SEQ ID NOs: 385 and 416 may be interchanged with the corresponding polypeptides encoded by the human cDNA of clones 105-021-3-0-C3-CS and 188-31-1-0-E6-CS. Further included in the invention are polynucleotides encoding said polypeptides. Preferred polynucleotides are those of SEQ ID NOs: 144 and 175 and of the human cDNA of clones 105-021-3-0-C3-CS and 188-31-1-0-E6-CS.

Another embodiment of the invention to methods of using the nucleotidic sequence or part thereof of invention to search homologs to the protein of invention. The sequence can be used as template of PCR reactions, allowing the detection/quantification of the protein of invention or part of thereof or the homologs. The complementary sequence or part of thereof may be used as hybridization probes to detect/quantify the transcription level, as well in in vitro level as the cellular level. In particular, such probes may be used in a diagnostic context, for example in the cellular or tissue in situ hybridization.

Another embodiment of the invention to methods of using the nucleotidic sequence or part thereof of invention to design antisense oligonucleotides to modulate the in vitro or in vivo expression of the protein or the part or thereof gene expression. This may be useful in therapeutic area of diseases listed above, particularly in the context where the protein of invention is expressed in abnormally high level.

In a further embodiment of the invention, the protein of invention or portions thereof are used to produce specific antibodies. These antibodies may have applications in the diagnostics, the purification of the protein of invention or part of thereof or a homolog. They may also help to vizualise the locations of the proteins associated to the protein of invention in the cell, in particular for highlighting structure-related proteins. The methods described herein in which protein antibodies are employed may be performed, for example, by utilizing pre-packaged diagnostic kits comprising at least one specific cDNA of SEQ ID NO. or antibody reagent described herein, which may be conveniently used, for example, in clinical settings, to diagnose patients exhibiting symptoms of various CNS disorders.

In still another preferred embodiment, the present inventions relates to methods of using the protein of the invention or part thereof in gene therapy, particularly in the diseases involving the CNS, particularly in the context where the protein of the invention is expressed in abnormally low level. Gene therapy is a potential therapeutic approach in which normal copies of the cDNAs of SEQ ID NOs: 144 and 175 may be introduced into subjects to successfully code for normal protein in several different affected cell types.

Another aspect of the present invention includes a formulation comprising the protein of the invention or part thereof and a pharmaceutically or physiologically acceptable carrier. A formulation of the present invention comprises a combination of one or more peptides as described herein, or mimetopes thereof; a combination of antibodies as described herein, or mimetopes thereof; or a combination of antibodies and peptides as described herein, or mimetopes thereof. Such a formulation may be administered to a subject in need thereof to treat or prevent a disorder associated with decreased expression or activity of the protein. Examples of such disorders include but are not limited to those of the CNS and other tissues where the association of actin appears to be abnormal.

Proteins of SEQ ID NO: 391, 393, 405 and 407 (Internal Designations 145-52-2-0-D12-CS, 145-7-3-0-D3-CS, 174-17-1-0-D6-CS and 174-38-4-0-D11-CS respectively)

The cluster of four proteins (SEQ ID NOs: 391, 393, 405 and 407) encoded by the cDNAs of SEQ ID NOs: 150, 152, 164 and 166 respectively is homologous to human claudin-8. Claudin-8 belongs to the PMP22-Claudin family (PF00822), a family of proteins characterized by four predicted membrane-spanning segments.

The protein of SEQ ID NO: 405 (174-17-1-0-D6-CS) is identical to claudin-8. The protein of SEQ ID NO: 393 contains two amino acid substitutions (T129A and S151P) with respect to the claudin-8 sequence (PF00822) and therefore represents an alternative allele of claudin-8. The proteins of SEQ ID Nos: 393 and 405 contain four membrane-spanning segments.

The proteins of SEQ ID NOs: 391 and 407 represent novel isoforms of claudin-8. The protein of SEQ ID NO: 391 (145-52-2-0-D12-CS) is 162 amino acids long, contains three predicted membrane-spanning segments, and has three amino acid substitutions (R31I, S151P and E162) with respect to the claudin-8 sequence (PF00822). The protein of SEQ ID NO: 407 (174-38-4-0-D11-CS) is 43 amino-acids long. SEQ ID NO: 407 contains a stop codon at position 44 and contains no predicted membrane-spanning segment. The proteins of SEQ ID NOs: 391 and 407 have novel function. The proteins of SEQ ID NOs: 391 and 407 do not have full claudin-8 function.

The Claudin family of proteins comprises more than twenty small glycoproteins with four predicted transmembrane domains. The tissue distribution pattern of claudins varies significantly, depending on claudin species. Many (including claudin-8) have been identified as components of tight junction (TJ) strands that play a role in regulation of cell permeability and polarity. Polarized epithelial and endothelial cells form barriers that separate biological compartments and regulate homeostasis. The TJ is a specialized membrane domain at the most apical region of polarized epithelial and endothelial cells that not only creates a primary barrier to prevent paracellular transport of solutes (barrier function) but also restricts the lateral diffusion of membrane lipids and proteins to maintain the cellular polarity. A relationship between claudin suppression and the alteration of TJ morphology is believed to correlate with the increase of endothelial permeability (Liebner S et al., Acta Neuropathol (Berl) 100(3):323–331 (2000) which disclosure is hereby incorporated by reference in its entirety).

In many intestinal (including inflammatory bowel disease and irritable bowel syndrome) and systemic diseases, intestinal barrier damage is marked by changes in intestinal permeability which are in turn related to alteration in TJ function (Gasbarrini G, Montalto Mital J Gastroenterol Hepatol 31 (6):481–488 (1999) which disclosure is hereby incorporated by reference in its entirety). Permeability of the TJs can be modified by bacterial toxins, cytokines, hormones and drugs.

Claudins have also been implicated in malignancy. For example, down regulation of the expression of claudin has been associated with oncogenesis in rat salivary gland epithelium cells (Li D and Mrsny R J J Cell Biol 148(4):791–800 (2000) which disclosure is hereby incorporated by reference in its entirety). The increase in microvascular permeability in human gliomas, contributing to clinically severe symptoms of brain edema, appears to be the result of a dysregulation of junctional proteins. Increased TJ permeability of the colon epithelium, and consequently a decrease in epithelial barrier function, precedes the development of colon tumors, including carcinomas and adenomatous polyps (Soler A P et al., Carcinogenesis 20(8):1425–1431 (1999) which disclosure is hereby incorporated by reference in its entirety). Studies of the interendothelial junctions in tumor microvessels of human glioblastoma multiforme show that the expression of claudin is lost in the majority of tumor microvessels.

Opening of TJs by environmental proteinases may be the initial step in the development of asthma to a variety of allergens. The lung epithelium forms a barrier that allergens must cross before they can cause sensitization. The cysteine proteinase allergen Der p1 from fecal pellets of *Dermatophagoides pteronyssinus* (the house dust mite (HDM) causes disruption of intercellular TJs, the principal components of the epithelial paracellular permeability barrier. TJ breakdown nonspecifically increases epithelial permeability, allowing Der p1 to cross the epithelial barrier. Putative Der p1 cleavage sites were found in peptides from an extracellular domain of claudin. HDM allergens are important factors in the increasing prevalence of asthma (Wan H et al. J Clin Invest 104(1):123–33 (1999) which disclosure is hereby incorporated by reference in its entirety).

In a preferred embodiment, the present invention provides for a method to use the proteins of SEQ ID NOs: 391 and 407 for in vitro analysis of claudin-8 function. Further preferred is a method of using the proteins of SEQ ID NOs: 391 and 407 for in vitro analysis of the impaired claudin-8 function of said proteins. Further preferred is a method of in vitro analysis of signaling function of the protein of SEQ ID NO: 407. Further preferred is a method of in vitro analysis of signaling function of the protein of SEQ ID NO: 407 as it relates to the activation or differentiation of non-epithelial cells. Further preferred is a method of in vitro analysis of signaling function of the protein of SEQ ID NO: 407 as it relates to the activation or differentiation of leukocytes, keratinocytes, and endothelial cells.

In a preferred embodiment, the present invention provides for a method to determine the expression of the novel claudin-8 isoforms corresponding to the proteins of SEQ ID NOs: 391 and 407. Further preferred is a method of determining expression of the proteins of SEQ ID NOs: 391 and 407 as it relates to the profiling (for purposes of diagnosis or classification) of pathologies. Further preferred is a method of determining expression of the proteins of SEQ ID NOs: 391 and 407 as it relates to the profiling of Crohn's disease, ulcerative colitis, irritable bowel syndrome, allergic asthma, gliobastoma, colorectal carcinoma, and adenomatous polyps. Further preferred is a method of using nucleic acid sequence corresponding to the proteins of SEQ ID NOs: 391 and 407, namely that comprising SEQ ID Nos: 150 and 166 respectively, to determine the expression of the proteins of SEQ ID NOs: 391 and 407 in said pathologies. Further preferred is a method wherein reverse transcription-polymerase chain reaction (RT-PCR) is used in said method to determine the expression of the proteins of SEQ ID NOs: 391 and 407 in said pathologies. The methods of design of such RT-PCR analysis are known by those skilled in the art.

In a preferred embodiment, the present invention provides for a method in which the proteins of SEQ ID Nos: 391, 393, 405 and 407, or biologically active fragments thereof, are used to treat asthma or reduce the incidence of asthmatic attacks. Further preferred are compositions comprised of the proteins of SEQ ID Nos: 391, 393, 405 and 407, or biologically active fragments thereof Further preferred are formulation of said compositions that are compatible with therapeutic administration as an aerosol. Further preferred is a method wherein purified fragments or synthetically modified peptides derived from the extracellular domains of the proteins of SEQ ID Nos: 391, 393, 405 and 407 are administered in the said therapeutic regimen. Further preferred embodiment is a method of using said peptides wherein the peptides contain the putative cleavage sites for environmental allergen proteinases and wherein said peptides are administrated in amounts that competitively inhibit the proteinase activity of the allergen. Further preferred is a method of using said peptides in said treatment of asthma wherein the peptides are designed to bind inhibit allergen proteinase irreversibly.

The negative effects of the usual preservation solutions on epithelial and endothelial permeability in organs to be transplanted are generally known (Trocha S. D. et al. Ann.Surg. 230: 105–113 (1999) which disclosure is hereby incorporated by reference in its entirety). Increases in permeability lead to tissue injury and edema. Disorganization of TJ proteins appears to be responsible for the observed tissue injury and edema. In a preferred embodiment, the present invention provides for a method in which the proteins of SEQ ID Nos: 391, 393, 405 and 407, or biologically active fragments thereof, are used to maintain the content and integrity of TJs in organs to be transplanted. Further preferred embodiment is a method of using the proteins of SEQ ID Nos: 391, 393, 405 and 407, or biologically active fragments thereof, as constituents of the preservation solutions in order to improve the quality of said organs to be transplanted.

Claudins are unique proteins with specific protein-binding properties. In a preferred embodiment, the present invention provides for the use of the proteins of SEQ ID Nos: 391, 393, 405 and 407, or biologically active fragments thereof, as a component of drug delivery vehicles such as colloids or liposomes. Further preferred embodiment is the use of proteins of SEQ ID Nos: 391, 393, 405 and 407, or biologically active fragments thereof, in a method of specifically targeting therapeutic agents to epithelial cells. Further preferred is a method wherein the incorporation of the proteins of SEQ ID Nos: 391, 393, 405 and 407, or biologically active fragments thereof, into liposomes is used to specifically targent therapeutic agents carried by the liposomes to epithelial cells. The methods of design of such type of drug delivery systems is known by those skilled in the art (Smith H. J. Introduction to the principles of drug design and action, $3^{rd}$ ed. (1998) which disclosure is hereby incorporated by reference in its entirety). In a further preferred embodiment, the proteins of SEQ ID NOs: 391, 393, 405 and 407, or biologically active fragments thereof, are directly conjugated (either recombinantly or by using chemically active agents) to chemotherapeutic agents, radioisotopes, or prodrugs and said conjugate subsequently used in therapeutic regimens.

In further preferred embodiment, the present invention provides for a method of producing "bioartificial" epithelia from non-epithelial cells. The "bioartificial" epithelia produced according to the invention may be used for reconstructive surgical procedures, for treating of disorders related to epithelial loss (for hereditary, traumatic or oncological reasons) or for another therapeutic purposes (for example, burn treatments). Further preferred is a method of using the nucleic acids corresponding to the proteins of SEQ ID Nos: 391, 393, 405 and 407 wherein "bioartificial" epithelial cells are obtained by transfection of said nucleic acid, and consequential remodeling, of the patient's autologous cells not affected by any of said disorders. The use of autologous cells in the preparation of the "bioartificial" epithelial cells of the invention in methods of treating disorders, conditions, or diseases associated with the loss of epithelial cells reduces or eliminates the risk of tissue rejection typically observed in transplantation methodologies. Methods of bioartificial tissue engineering are generally known to those skilled in the art (for a review, see Machens H. G. et al. Cells Tissues Organs 167: 88–94 (2000) which disclosure is hereby incorporated in its entirety by reference).

The intestinal epithelium is a major barrier to the absorption of hydrophilic drugs. The presence of intercellular junctional complexes, particularly the TJs, renders the epithelium impervious to hydrophilic drugs, which cannot diffuse across the cells through the lipid bilayer of the cell membranes (Ward P D et al. Pharmaceutical Science and Technology Today 3:10:346–358 (2000) which disclosure is hereby incorporated by reference in its entirety). Therefore, in further preferred embodiment, the present invention provides for a method of using the proteins of SEQ ID NOs: 391, 393, 405 and 407, or biologically active fragments thereof, to increase the intestinal absorption of said hydrophilic drugs by increasing the paracellular permeability for said drugs. Preferred compositions of the proteins of SEQ ID NOs: 391, 393, 405 and 407, or biologically active fragments thereof, are those compatible with oral administration. In other preferred embodiment, the present invention provides for a method of using antisense polynucleotides corresponding to the proteins of SEQ ID NOs: 391, 393, 405 and 407 to down-regulate expression of said proteins. Further preferred is a method wherein said antisense polynucleotides are used to temporally increase epithelial permeability for therapeutic ends including but not limited to increasing the efficiency of drug delivery. Methods of designing, synthesizing, and using said antisense polynucleotides are well known to those skilled in the art.

In further preferred embodiment, the present invention provides for an antibody that specifically binds the novel isoforms of claudin-8 corresponding to the proteins of SEQ ID NOs: 391 and 407. Further preferred is a method of making said polyclonal antibody by immunization of a rabbit with said proteins or any fragments thereof. Methods of generating said polyclonal antibodies and of establishing their specificity are well known to those skilled in the art. Methods of establishing specificity are well known to those skilled in the art and include but are not limited to immunoprecipitation, Western blot analysis, and protein sequencing of immunoprecipitated material.

Further preferred is a method of making said antibody by immunization of a mouse with a syngeneic cell line overexpressing protein of SEQ ID NO:391 or with purified recombinant protein of SEQ ID NO:407. Methods of preparing said recombinant proteins are well known to those skilled in the art. Further preferred is a method of making a monoclonal antibody from said immunization of a mouse with a syngeneic cell line over-expressing protein of SEQ ID NO:391 or with purified recombinant protein of SEQ ID NO:407. Further preferred is a method of making a monoclonal antibody from said immunization of a mouse with a syngeneic cell line over-expressing protein of SEQ ID NO:391 or with purified recombinant protein of SEQ ID NO:407. Further preferred is a method of identifying SEQ ID NO:391-specific and SEQ ID NO:470-specific monoclonal antibodies by differential screening on a syngeneic cell line over-expressing protein of SEQ ID NO:391 or on purified recombinant protein of SEQ ID NO:407, respectively, versus a syngeneic cell line over-expressing human claudin-8 protein. Methods of generating said monoclonal antibodies and of establishing specificity are well known to those skilled in the art. Methods of establishing specificity are well known to those skilled in the art and include but are not limited to immunoprecipitation, Western blot analysis, and protein sequencing of immunoprecipitated material.

Further preferred is a method of contacting said polyclonal or monoclonal antibody with the proteins of SEQ ID NOs: 391 and 407. Further preferred is a method of using said antibody to isolate said proteins from either natural or recombinant sources. Further preferred is a method of using said antibody to determine the level of expression of said proteins within bodily fluids or tissues. Further preferred is a method of using said antibody to isolate said proteins from bodily fluids or tissue preparatory to in vitro analysis of in vivo modifications of said proteins. Further preferred is a method of using said antibody to determine the level of expression of said proteins as it relates to the diagnosis or classification of pathologies. Further preferred is a method of using said antibody to determine the level of expression of said proteins as it relates to the diagnosis or classification of Crohn's disease, ulcerative colitis, irritable bowel syndrome, allergic asthma, gliobastoma, colorectal carcinoma, and adenomatous polyps. Further preferred is a method of using said antibody to investigate regulation of the level of SEQ ID NO:391 or SEQ ID NO:470 protein expression in response to the proinflammatory factors tumor necrosis factor-alpha (TNF-alpha), interleukin-1 beta (IL-1 beta), interleukin-8 (IL-8), and complement factor 5a (C5a).

Further preferred is a method to use a humanized version of the aforementioned SEQ ID NO:391 or SEQ ID NO:470 monoclonal antibody in a method to treat impaired claudin-8 function. Further preferred is a method of using said antibody to up-regulate claudin-8 function in associated pathologies Crohn's disease, ulcerative colitis, irritable bowel syndrome, allergic asthma, gliobastoma, colorectal carcinoma, and adenomatous polyps. Preferred composition is the said antibody. Preferred formulations are those amenable to the administration by injection or, in the case of allergic asthma, administration by aerosol.

Further preferred is a method wherein said humanized monoclonal antibodies are used to temporally increase epithelial permeability for therapeutic ends including but not limited to increasing the efficiency of drug delivery, analogous to that discussed above. Preferred formulations are those comprising said antibody that are compatible with oral delivery.

The invention further relates to a method of screening libraries of compounds for test compounds that specifically bind to the proteins of SEQ ID NOs: 391 and 407 (obtained from either natural or recombinant sources), or fragments thereof, and either suppress or enhance claudin-8 function in said proteins. The proteins of SEQ ID NOs: 391 and 407 that are employed in such screening are either free in solution, affixed to a solid support, recombinantly expressed on or chemically attached to a cell surface, or positioned intracellularly. The formation of binding complexes between said protein of interest and the compound being tested may be measured by methods well known to those skilled in the art. Proteins of SEQ ID Nos: 278, 282 and 300 (Internal Designations 160-37-2-0-H7-CS, 174-33-3-0-F6-CS, 184-4-1-0-A11-CS respectively)

The protein of SEQ ID No: 278 (and the corresponding allelic variants 282 and 300) encoded by the cDNA SEQ ID No: 37 (41, 59 Respectively) shows homology to a human transmembrane protein (HTMN-23, Genseq accession number Y57899). The protein of SEQ ID No: 278 (and the corresponding polymorphic variants 282 and 300) overexpressed in salivary gland contains 9 potential transmembrane segments from positions 85 to 105, 116 to 136, 164 to 184, 187 to 207, 332 to 352, 376 to 396, 404 to 424, 465 to 485 and 499 to 519, thus displaying chracteristic features of type III transmembrane proteins (Singer, Annu. Rev. Cell Biol., 6:247–296, 1990). Furthermore, a predicted localisation in the endoplasmic reticulum (ER) is found for the protein of the invention with the software psort.

The normal fonctioning of the eukaryotic cell requires that all the newly synthesized proteins be correctly folded, modified, and delivered to specific intra- and extracellular sites. Newly synthesized membrane and secretory proteins enter a cellular sorting and distribution network during or immedialety after synthesis and are routed to specific locations inside and outside the cell. The initial compartment in this process is the endoplasmic reticulum (ER) where proteins undergo modifications such as glycosylation, disulfide bond formation, and assembly into oligomers. The modified proteins are then transported through a series of membrane-bound compartments which include the various cisternae of Golgi complex where further carbohydrate modifications occur. Transport between compartments occurs by means of vesicles that bud and fuse in a manner specific to the type of protein being transported. Once within the secretory pathway, proteins do not have to cross a membrane to reach the cell surface. Disruptions in the cellular secretory pathway have been implicated in several human diseases. In familial hypercholesterolemia the low density lipoprotein receptors remain in the ER rather than moving to the cell surface (Pathak, et al., J. Cell Biol., 106:1831–1841, 1988). Altered transport and processing of the beta-amyloid precursor protein (betaAPP) involves the putative vesicle transport protein prenesilin, and may play a role in early-onset Alzheimer disease (Levy-Lahad et al., Science, 269:973–977, 1995). Changes in the ER-derived calcium homeostasis have been associated with diseases such as cardiomyopathy, cardiac hypertrophy, myotonic dystrophy, Brody disease, Smith-McCort dysplasia and diabetes mellitus.

It is believed that the protein of the invention represents a new ER integral transmembrane protein. This protein plays probably a role in post-translational modifications of secreted and membrane proteins. Its dysregulated expression may be linked to disorders such as the above referred diseases. Preferred polypeptides of the invention are polypeptides comprising the amino acids of SEQ ID Nos: 278, 282 and 300 from positions 85 to 105, 116 to 136, 164 to 184, 187 to 207, 332 to 352, 376 to 396, 404 to 424, 465 to 485 and 499 to 519. Other preferred polypeptides of the invention are fragments of SEQ ID Nos: 278, 282 and 300 having any of the biological activity described herein.

One object of the present invention are compositions and methods of targeting heterologous polypeptides to the endoplasmic reticulum by recombinantly or chemically fusing a fragment of the proteins of the invention to an heterologous polypeptide. Preferred fragments are any fragments of the proteins of the invention, or part thereof, that may contain targeting signals for the endoplasmic reticulum such as those described in Pidoux A L, Armstrong EMBO J 1992 April;11(4):1583–91; Munro S, Pelham H R Cell 1987 Mar. 13;48(5):899–907; Pelham H R Trends Biochem Sci 1990 December;15(12):483–6.

In another embodiment, the invention relates to methods and compositions using the protein of the invention or part thereof as marker proteins to selectively identify tissues, preferably salivary glands. For example, the proteins of the invention or part thereof may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

Moreover, antibodies to the proteins of the invention or parts thereof may be used for the detection of endoplasmic reticulum in immunochelistry for example using any techniques known to those skilled in the art including those described herein.

Protein of Seq Id No: 281 (174-10-2-F8-CS)

The protein of SEQ ID No: 281 is homologous to PET117 (SwissProt ID: Q02771). MTC is overexpressed in the brain, dystrophic muscle, fetal liver, placenta and salivary glands. The protein of the invention, herein named MTC, presents a certain homology with the yeast PET117 protein precursor (22% identical amino acids, 39% positive amino acids when aligned by BLASTP 2.0.9). MTC appears to be a novel member of the PET family.

Cytochrome c oxidase (complex IV), an enzyme complex located in the mitochondrial inner membrane, is the terminal member of the mitochondrial electron transport chain. The oxidation reaction catalyzed by cytochrome c oxidase is exergonic and is coupled to the translocation of protons across the membrane. This reaction provides the energy needed to drive the synthesis of ATP by the mitochondrial oxidative phosphorylation system and is essential for respiratory metabolism in aerobic eukaryotes. Cytochrome c oxidase is made up of as many as 13 non-identical protein subunits, of which 3 are encoded by the mitochondrial genome, and contains several prosthetic groups (including heme groups a and $a_3$).

The composition of cytochrome c oxidase requires that synthesis and assembly of a functional enzyme complex occur in several distinct steps, including: 1) synthesis of the protein subunits, 2) transport of the subunits from their site of synthesis to their site of function in the mitochondrial inner membrane, 3) synthesis of hemes a and $a_3$ and, 4) assembly of the subunits with each other and with the prosthetic group. A number of "accessory" genes (e.g., not encoding protein subunits of the final assembled cytochrome c oxidase complex) are required for the production of functional cytochrome c oxidase (McEwen J E et al.—J Biol Chem—1986, 261(25):11872–9). Some of these are required for the expression of mitochondrial-encoded cytochrome c oxidase subunits, while others are needed for the proper assembly of active cytochrome c oxidase.

The nuclear genes PET117 and PET 191 belong to this class of "accessory genes" required for the assembly of active mitochondrial cytochrome c oxidase (McEwen J E et al.—Curr Genet.—1993, 23(1):9–14). The role of PET genes and the proteins that they encode remains obscure, although mutation experiments in S cerevisae have clearly shown that they are essential for the production of active cytochrome c oxidase (McEwen J E et al.—J Biol Chem—1986, 261(25):11872–9) (McEwen J E et al.—Curr Genet.—1993, 23(1):9–14).

One aspect of the subject invention provides to compositions and methods of using the nucleotide sequence of SEQ ID No: 40, or its complement, in molecular biology techniques. In one embodiment, the MTC2 sequence is encoded by clone 174-10-2-0-F8-CS. References to a polynucleotide of SEQ ID NO: 40 and polypeptide of SEQ ID NO: 281 are interchangeable with the corresponding polynucleotides of the human cDNA of clone 174-10-2-0-F8-CS and polypeptides encoded thereby. These techniques include, but are not limited to: PCR; production of recombinant MTC, or biologically active fragments thereof, generating antisense RNA and DNA, their chemical analogs and the like; hybridization probes; and chromosome gene mapping.

As is apparent to one skilled in the art, all of the non-limiting techniques listed above can be practiced with fragments of the mtc2 gene. Given the well-known nature of these techniques, the skilled artisan will be able to select an appropriate length of the mtc2 polynucleotide for use in the techniques. For recombinant expression of protein, a preferred embodiment provides the full length MTC2 gene in an expression vector.

For example, nucleotide sequence of SEQ ID No: 40 or its complement can be used to generate hybridization probes for mapping the naturally occurring genomic sequence. The sequence can be mapped to a particular chromosome or to a specific region of the chromosome using well-known techniques. These include in situ hybridization to chromosomal spreads, flow-sorted chromosomal preparations, or artificial chromosome constructions such as yeast artificial chromosomes, bacterial artificial chromosomes, bacterial P1 constructions or single chromosome cDNA libraries as reviewed in Price (Price C M—Blood Rev.—1993, 7(2):127–34) and Trask B (Trask B J—Trends Genet.—1991, 7(5):149–54).

In situ hybridization of chromosomal preparations and physical mapping techniques such as linkage analysis using established chromosomal markers are invaluable in extending genetic maps that provides valuable information to investigators searching for disease genes using positional cloning or other gene discovery techniques. Once a disease or syndrome has been crudely localized by genetic linkage to a particular genomic region, any sequences mapping to that area can represent associated or regulatory genes for further investigation. The nucleotide sequence of the present invention can also be used to detect differences in the chromosomal location due to translocation, inversion, etc. among normal, carrier or affected individuals.

The subject invention also provides methods of using MTC polypeptides and polynucleotides encoding said polypeptides in preventing or reducing the incidence of apoptosis in cells. Dysfunctions in the mitochondrial electron transport chain result in cellular apoptosis or necrosis. In one embodiment, MTC is added to an in vitro culture of mammalian cells in an amount effective to reduce apoptosis. In another embodiment, cells are transfected with vectors comprising MTC polynucleotides which cause the expression of MTC peptides. MTC used in these embodiments can, optionally, contain mitochondrial targeting sequences. In another embodiment, MTC or MTC2 are encoded by clone 174-10-2-0-F8-CS.

In another embodiment, MTC polypeptides and polynucleotides encoding said polypeptides can be used in the diagnosis, treatment and/or prophylaxis of disorders associated with apoptosis or impairment of the mitochondrial respiratory electron transport chain. Polynucleotides can also be used in antisense protocols for certain disorders to impair the function of the mitochondrial electron transport chain. These disorders include, but are not limited to, immune deficiency syndromes (including AIDS); type I diabetes; pathogenic infections; cardiovascular and neurological injury; alopecia; aging; degenerative diseases such as Alzheimer's Disease, Parkinson's Disease, Huntington's disease; dystonia; Leber's hereditary optic neuropathy; schizophrenia; neonatal hepatic failure and ketoacidotic coma necrosis; and myodegenerative disorders such as "mitochondrial encephalopathy, lactic acidosis, and stroke" (MELAS), "myoclonic epilepsy ragged red fiber syndrome" (MERRF); mitochondriocytopathies, Leigh syndrome, fatal infantile cardioencephalomyopathy, ataxia; encephalopathies, aging, neurodegenerative diseases, myopathies, and cancers. As would be apparent to the routineer, these methods can be practiced with full length MTC polypeptides and polynucleotides encoding said polypeptides as well as biologically active fragments of the same which retain biological activity.

For diagnostic purposes, the expression of the protein of the invention could be investigated using any of the Northern blotting, RT-PCR or immunoblotting methods well known to those skilled in the art. For prophylaxis and/or treatment purposes SEQ ID No: 40, its complement, or fragments of either, can be used to enhance electron transport and increase energy delivery using any of the gene therapy methods known to those skilled in the art. Likewise, SEQ ID NO: MTC2, its complement, and fragments of either can be used to impair electron transport and decrease energy delivery using any of the antisense methodologies known to those skilled in the art.

Protein of SEQ ID NO:392 (145-7-2-0-G5-CS)

The protein of SEQ ID No:392, encoded by the cDNA of SEQ ID No:151, is homologous to Unc-18 proteins, also known as the STXBP or Sec-1 family. The protein of the invention is strongly expressed in the fetal kidney.

Amino acids 89 to 107 of the protein of the invention present the EMotif signature for proteins of the Sec-1 family (BlocksPlus PF00995). Furthermore, BLAST analysis (BLASTP version 2.0.9) of the amino acid sequence of the invention reveals that it is homologous to a number of proteins belonging to the Unc-18/Sec-1 family. Preferred polypeptides of the invention are those that comprise amino acids 94, 95, and/or 100, which are conserved in more than 80% of the Sec-1 family members; and/or amino acids 43, 89, and/or 97, which are conserved in more than 60% of Sec-1 family members. Other preferred polypeptides of the invention are any fragment of SEQ ID NO:392 having any of the biological activities described herein.

The normal function and organization of eukaryotic cells is dependent on transport of various vesicles that selectively shuttle membrane and cargo between distinct compartments of the secretory and endocytotic pathways. A number of key proteins involved in membrane targeting and exocytosis have been identified, and a fundamental set of interactions has been defined and placed into a model called the SNARE (Soluble N-ethylmaleimide-sensitive Attachment protein REceptor) hypothesis (Rotheman J—Nature—1994, 372: p55–63). According to the SNARE hypothesis, vesicles dock to a target membrane through the interaction of complementary sets of vesicular (v-SNARE) and target (t-SNARE) membrane proteins. Our understanding of vesicle trafficking has, to a large extent, been facilitated by characterization of synaptic vesicles in neurons. In synaptic vesicle exocytosis, the vesicular protein synaptobrevin (also called Vesicle-Associated Membrane Protein; VAMP) is the v-SNARE, and the plasma membrane-associated protein SNAP-25 (Synaptosomal-Associated Protein of 25 kDa) and syntaxin 1 function as t-SNARE. Formation of the SNARE complex (or core complex) is followed by recruitment of the cytosolic proteins alpha, beta and gamma SNAP (Soluble N-ethylmaleimide-sensitive Attachment Protein) and NSF (N-ethylmaleimide-Sensitive Factor), which are required for membrane fusion. Proteins from two gene families have been identified as key regulators of SNARE complex assembly. These include members of the small GTP-binding family (e.g. Rabs) and the Sec-1 family. The Sec-1 gene is one of ten genes identified as essential for the final stages of protein secretion in yeast (S. cerevisae). Sec-1 homologues have been identified in the nervous system of C. elegans (Unc-18), D. melanogaster (Rop) and mammals. In mammals, the protein has been termed Mammalian homologue of the Unc-18 gene (Munc-18), rbSec1 (Rat Brain Sec1) or n-Sec1 (neural-specific Sec1).

Sec-1-related proteins are involved in the processes of vesicle targeting, docking and/or fusion. Sec-1-related proteins interact directly with the t-SNARE syntaxin, and Munc-18 has been found to interact with syntaxin isoforms 1a, 2 and 3. However, Munc-18 has not been found to be part of the 20S SNARE/SNAP/NSF protein complex. In vitro, the binding of Munc-18 to syntaxin inhibits the interaction of syntaxin with VAMP and SNAP-25 as well as SNAP-23 (a homologue of SNAP-25) and thereby negatively regulates the formation of the synaptic SNARE fusion complex. In agreement with a negative regulatory role of Sec-1/Munc-18 proteins in neurotransmitter release are results showing that microinjections of Sec-1 into the presynaptic terminal of the giant squid synapse inhibits evoked transmitter release (Dresbach T. et al.—J Neurosci.—1998, 18: p2923–2932). Furthermore, overexpression of Rop, Unc-18, Sec-1 and Munc-18 all result in phenotypes associated with a complete block in neurotransmitter release and/or secretion (Hosono R. et al.—J Neurochem—1992; 58: p1517–1525; Harrison S. et al.—Neuron—1994; 13: p555–566; Novick P. et al.—Cell—1981; 25: p461–469; verhage M. et al.—Science—2000; 287: p864–869). Point mutation experiments involving the Rop gene suggest that Rop is a rate-limiting regulator of exocytosis that performs both stimulatory and inhibitory functions in neurotransmission (Wu M. et al.—EMBO J—1998; 17: p127–139). The reduction in neurotransmitter release seen after both overexpression of Munc-18 and mutations in Munc-18 homologues indicates that Sec-1 proteins not only sequester syntaxins from other proteins but also assist the syntaxins in adopting a functional conformation or facilitate interactions between syntaxins and other proteins by a chaperone-like action. The necessity of Sec1-related proteins is believed to result, in part, from their direct and high affinity interaction with members of the t-SNARE family of syntaxin proteins and from the control by this complex of a v-and t-SNARE protein interaction required for vesicle fusion.

The SNARE mechanism of exocytosis appears to be conserved both evolutionarily (most of the components have homologues in species from yeast to mammals) and functionally (each of the principal components are members of multigene families). This latter point is supported by work showing that components of this pathway are found in different cell types (neurons, neutrophiles and pancreatic beta-cells) (brumell J. et al.—J immunol—1995; 155: p5750–5759; Zhang W et al.—J Biol Chem.—2000 Oct. 6, electronic publication).

It is believed that the protein of SEQ ID NO:392 is a member of the Unc-18/Sec-1 family, and thus plays a key role in the regulation of various processes including vesicle targeting, docking and fusion.

One embodiment of the present invention relates to the use of the protein of SEQ ID NO:392 or the cDNA of SEQ ID NO:151 or any part thereof to used to identify fetal kidney tissue and cells derived from this tissue, since the protein of the invention is strongly expressed in this tissue. In addition, the protein of the invention can be used to specifically label components of the secretory pathway within cells. Assays for the detection of cells expressing the protein of the invention, or part thereof, can be developed using techniques known to those skilled in the art. For example, the protein of the invention, or part thereof, can be used to generate antibodies or antiserum, by techniques well known to those skilled in the art. Antibodies or antiserum can also be used for quantitative analysis or detection of the protein of the invention, by methods such as enzyme-linked immunosorbant assays (ELISA) or by any other technique known to those skilled in the art. Another possible technique involves the use of marked syntaxins, since Sec1-related proteins are known to bind to syntaxins.

In another embodiment of the present invention, the present polynuleotides and polypeptides can be used to diagnose, treat, and/or prevent of a large number of diseases and disorders characterized by abnormal exocytosis, such as, but not limited to: allergies including hay fever, asthma, and urticaria; neurologic disorders, a number of which result from abnormal neurotransmitter secretion (for example, depression is associated with decreased serotonin secretion); autoimmune hemolytic anemia; cancers, especially hormone-dependent cancers such as those stimulated by androgens (for example, prostate cancer) or estrogens (for example, breast cancer), leukemias or lymphomas; ulcerative colitis; type 2 diabetes, which in some cases is associated with decreased insulin secretion; proliferative granulonephritis; inflammatory bowel disease; growth failure due to decreased secretion of growth hormone; multiple sclerosis; myasthenia gravis, rheumatoid and osteoarthritis; scleroderma,; Chediak-Higashi and Sjogren's syndromes; systemic lupus erythematosus; thyroiditis; toxic shock syndrome; traumatic tissue damage; viral, bacterial, fungal and protozoal infections; and other physiologic/pathologic disorders associated with induced or otherwise abnormal vesicular trafficking.

An association between the level of expression and/or activity of the present protein with the presence or absence of any condition associated with abnormal vesicular trafficking, such as any of the above-listed disorders, can readily be assessed by detecting the level of expression or activity of the protein by, e.g., Northern blot, western blot, ELISA, or any standard in vitro or in vivo assay for protein activity, and correlating the observed level or expression or activity with the presence or absence of the disorder. For those disorders found to be positively associated with the protein of the invention, a diagnostic or screening assay can be readily developed where the detection of an elevated level of protein or protein activity is indicative of the presence of the disease, or of a propensity to develop the disease. Further, any such diseases or conditions can be treated or prevented by inhibiting the expression or activity of the protein, for example by administering to a patient suffering from the disorder any inhibitor including, but not limited to, antibodies, antisense oligonucleotides, dominant negative forms of the protein, and small molecule inhibitors of protein expression or activity. Alternatively, disorders negatively associated with the protein of the invention can be diagnosed or screened for by detecting the level of the present protein or protein activity, where a decreased level of the protein or protein activity is indicative of the presence of the disease, or of a propensity to develop the disease. Such disorders negatively associated with the protein of the invention can be treated or prevented by increasing the level of the protein or protein activity, for example by administering to a patient any of a number of agents including, but not limited to, the protein itself, a polynucleotide encoding the protein, or a heterologous compound that enhances the expression or activity of the protein.

Protein of SEQ ID NO:419 (Internal Designation 188-9-1-0-C10-CS)

The protein of SEQ ID NO:419, highly expressed in the brain and placenta, is encoded by the cDNA of SEQ ID NO:178, is localized preferentially in the endoplasmic reticulum, and is homologous to the yeast integral membrane protein SFT2p, a member of the SNARE-related family (Genbank accession number X79489). SFT2p is well conserved in *C. elegans* and in mice (accession numbers CAA93859 and AA790425 respectively), and plays an important role in the protein trafficking and fusion machinery of eukaryotic cells. The 159-amino-acid-long protein of the invention, which is similar in size and in membrane topology to the SFT2p protein, displays four conserved hydrophobic stretches from positions 36 to 56, 66 to 86, 98 to 118 and 122 to 142, forming a tetra-spanning membrane protein. This topology is also found in the Got1p protein, another well-conserved SNARE related protein with similar functions to those of SFT2p protein (accession number AL010285 for *P. falciparum*, U23521 for *C. elegans*) as described in Conchon et al., EMBO J., 18(14):3934–3946 (1999).

Eukaryotic proteins are synthesized within the endoplasmic reticulum (ER), are delivered from the ER to the Golgi complex for post-translational processing and sorting, and are transported from the Golgi to specific intracellular and extracellular destinations. This intracellular and extracellular movement of protein molecules is termed vesicle trafficking. Trafficking is accomplished by the packaging of protein molecules into specialized vesicles which bud from the donor organelle membrane and fuse to the target membrane (Palade, Science 189:347–358 (1975)).

Numerous proteins are necessary for the formation, targeting, and fusion of transport vesicles and for the proper sorting of proteins into these vesicles. The vesicle trafficking machinery includes coat proteins which promote the budding of vesicles from donor membranes, vesicle- and target-specific identifiers (v-SNAREs and t-SNAREs) which bind to each other and dock the vesicle to the target membrane (Nichols et al., Nature 387:199–202, 1997), and proteins which bind to SNARE complexes and initiate fusion of the vesicle to the target membrane (SNAPs).

SFT2p is a conserved yeast protein with four transmembrane domains that is resident in punctate structures corresponding to the late Golgi compartment, and which enters presumptive retrogade intra-Golgi vesicles whose fusion depends on two t-SNARE proteins Sed5p and Sft1p (Wooding and Pelham, Mol. Biol. Cell 9:2667–2680 (1998)). Its genetic interaction with Sed5p suggests that SFT2p is an additional membrane component involved in the docking or fusion process. In vivo experiments have shown that deletion of GOT1p or SFT2p alone does not affect cell growth, but repression of both of these proteins results in a significant accumulation of ER membrane, suggesting that the presence of either SFT2p or GOT1p is required for the maintenance of efficient ER-Golgi transport (Conchon et al., supra). It has also been shown that Got1p normally facilitates Sed5p-dependant fusion events, while Sft2p performs a related function in the late Golgi (Conchon et al., supra).

The etiology of numerous human diseases and disorders can be attributed to defects in the trafficking of proteins to organelles or the cell surface. For example, defects in the trafficking of membrane-bound receptors and ion channels have been implicated in cystic fibrosis (cystic fibrosis transmembrane conductance regulator; CFTR), glucose-galactose malabsorption syndrome (Na.sup.+/glucose cotransporter), hypercholesterolemia (low-density lipoprotein (LDL) receptor), and forms of diabetes mellitus (insulin receptor). Abnormal hormonal secretion has been linked to disorders including diabetes insipidus (vasopressin), hyper- and hypoglycemia (insulin, glucagon), Grave's disease and goiter (thyroid hormone), and Cushing's and Addison's diseases (adrenocorticotropic hormone; ACTH).

Further, cancer cells secrete excessive amounts of hormones or other biologically active peptides. Disorders related to excessive secretion of biologically active peptides by tumor cells include: fasting hypoglycemia due to increased insulin secretion from insulinoma-islet cell tumors; hypertension due to increased epinephrine and norepinephrine secreted from pheochromocytomas of the adrenal medulla and sympathetic paraganglia; and carcinoid syndrome, which includes abdominal cramps, diarrhea, and valvular heart disease, caused by excessive amounts of vasoactive substances (serotonin, bradykinin, histamine, prostaglandins, and polypeptide hormones) secreted from intestinal tumors. Ectopic synthesis and secretion of biologically active peptides (peptides not expected from a tumor) includes ACTH and vasopressin in lung and pancreatic cancers; parathyroid hormone in lung and bladder cancers; calcitonin in lung and breast cancers; and thyroid-stimulating hormone in medullary thyroid carcinoma.

It is believed that the protein of SEQ ID NO:419 or part thereof is an integral membrane protein of the SNARE-related family, and more presumably is the human homologue of the yeast SFT2p protein. Thus, the protein of the invention plays a role in the secretory and endocytic pathway of eukaryotic cells through fusion and transport of vesicles from the endoplasmic reticulum to late Golgi cisternae. Preferred polypeptides of the invention are polypeptides comprising the amino acids of SEQ ID NO:419 of the four transmembrane domains from positions 36 to 56, 66 to 86, 98 to 118 and 122 to 142. Other preferred polypeptides of the invention are fragments of SEQ ID NO:419 having any of the biological activities described herein.

In one embodiment, the invention relates to methods and compositions using the protein of the invention or part thereof as a new marker protein to selectively identify secretory and endocytic traffic, preferably in the endoplasmic reticulum and more preferably in the late Golgi cisternae. For example, the protein of the invention or part thereof may be detected using specific antibodies generated against the protein using any technique known to those skilled in the art. Such organelle-specific antibodies may then be used to identify cells with disrupted trafficking systems such as in differentiated tumor cells or to differentiate specific organelle types in a cell cross-section using immunochemistry. In addition, the protein of the invention can be used to specifically identify cells of the brain and/or placenta, tissues in which the protein is overexpressed.

Another embodiment of the present invention relates to methods of targeting heterologous compounds, such as polypeptides or polynucleotides, to the endoplasmic reticulum and preferentially to late Golgi vesicles by recombinantly or chemically fusing a fragment of the protein of the invention to the heterologous polypeptide or polynucleotide. Such fusion proteins may be engineered to contain a cleavage site located between a sequence encoding the protein of the invention and the heterologous protein sequence, so that the protein of the invention may be cleaved and purified away from the heterologous moiety. Preferred fragments of the protein that can be used in such applications are the four transmembrane domains or any other fragments of the protein of the invention, or part thereof, that may contain targeting signals for ER or Golgi organelles as defined in Conchon et al., supra; Wooding and Pelham, supra. Such heterologous compounds may be targeted to the secretory pathway to modulate ER-Golgi endocytic and secretory activities. In one embodiment, the protein of the invention can be used to screen peptide libraries for inhibitors of traffic activity, as detected by the accumulation of ER membranes or Golgi vesicles as described in Conchon et al., supra.

In still another embodiment, the protein of the invention is used to diagnose, prevent and/or treat any of a number of disorders in which trafficking and/or the fusion machinery is affected, including, but not limited to, endocrine, secretory, inflammatory, and gastrointestinal disorders, such as cancer, cystic fibrosis (cystic fibrosis transmembrane conductance regulator; CFTR, as well as membrane-bound receptors and ion channels associated with CFTR), glucose-galactose malabsorption syndrome (Na.sup.+/glucose cotransporter), hypercholesterolemia (low-density lipoprotein (LDL) receptor), and forms of diabetes mellitus (insulin receptor), abnormal hormonal secretion linked to disorders including diabetes insipidus (vasopressin), hyper- and hypoglycemia (insulin, glucagon), Grave's disease and goiter (thyroid hormone), Cushing's and Addison's diseases (adrenocorticotropic hormone; ACTH), disorders related to excessive secretion of biologically active peptides by tumor cells including fasting hypoglycemia due to increased insulin secretion from insulinoma-islet cell tumors, hypertension due to increased epinephrine and norepinephrine secreted from pheochromocytomas of the adrenal medulla and sympathetic paraganglia, carcinoid syndrome, which includes abdominal cramps, diarrhea, and valvular heart disease, caused by excessive amounts of vasoactive substances (serotonin, bradykinin, histamine, prostaglandins, and polypeptide hormones) secreted from intestinal tumors. Ectopic synthesis and secretion of biologically active peptides (peptides not expected from a tumor) includes ACTH and vasopressin in lung and pancreatic cancers; parathyroid hormone in lung and bladder cancers; calcitonin in lung and breast cancers; and thyroid-stimulating hormone in medullary thyroid carcinoma.

An association between the level of expression and/or activity of the present protein with the presence or absence of any condition associated with abnormal vesicular trafficking and/or secretion, such as any of the above-listed disorders, can readily be assessed by detecting the level of expression or activity of the protein by, e.g., Northern blot, western blot, ELISA, or any standard in vitro or in vivo assay for protein activity, and correlating the observed level or expression or activity with the presence or absence of the disorder. For those disorders found to be positively associated with the protein of the invention, a diagnostic or screening assay can be readily developed where the detection of an elevated level of protein or protein activity is indicative of the presence of the disease, or of a propensity to develop the disease. Further, any such diseases or conditions can be treated or prevented by inhibiting the expression or activity of the protein, for example by administering to a patient suffering from the disorder any inhibitor including, but not limited to, antibodies, antisense oligonucleotides, dominant negative forms of the protein, and small molecule inhibitors of protein expression or activity. Alternatively, disorders negatively associated with the protein of the invention can be diagnosed or screened for by detecting the level of the present protein or protein activity, where a decreased level of the protein or protein activity is indicative of the presence of the disease, or of a propensity to develop the disease. Such disorders that are negatively associated with the protein of the invention can be treated or prevented by increasing the level of the protein or protein activity, for example by administering to a patient any of a number of agents including, but not limited to, the protein itself, a polynucleotide encoding the protein, or a heterologous compound that enhances the expression or activity of the protein.

Cancer cells secrete excessive amounts of hormones or other biologically active peptides. Therefore, in another embodiment, antagonists or inhibitors of the protein of the invention may be administered to a subject to treat or prevent cancers by inhibiting the traffic activity in transformed cells. Any type of cancer can be treated or prevented in this way, including, but not limited to, adenocarcinoma, sarcoma, melanoma, lymphoma, and leukemia. In preferred embodiments, the cancers include cancers of glands, tissues, and organs involved in secretion or absorption, such as prostate, pancreas, lung, tongue, brain, breast, bladder, adrenal gland, thyroid, liver, uterus, ovary, kidney, testes, and organs of the gastrointestinal tract including small intestine, colon, rectum, and stomach. In a particular aspect, antibodies which are specific for the protein of the invention may be used directly as an antagonist, or indirectly as a targeting or delivery mechanism for bringing a pharmaceutical agent to cells or tissues which express the protein of the invention. In addition, the elevated amount of the protein of the invention in tumor cells can readily be used to diagnose or screen for cancer, e.g. by measuring and comparing the level of the protein in a cell to that of a control cell using a specific antibody detected by FACS or using any other detection method known to those of skill in the art.

Protein of SEQ ID NO: 297 (181-3-3-0-C9-CS)

The cluster of four proteins (SEQ ID NOs: 391, 393, 405 and 407) encoded by the cDNAs of SEQ ID NOs: 150, 152, 164 and 166 respectively is homologous to human claudin-8. Claudin-8 belongs to the PMP22-Claudin family (PF00822), a family of proteins characterized by four predicted membrane-spanning segments.

The protein of SEQ ID NO: 405 (174-17-1-0-D6-CS) is identical to claudin-8. The protein of SEQ ID NO: 393 contains two amino acid substitutions (T129A and S151P) with respect to the claudin-8 sequence (PF00822) and therefore represents an alternative allele of claudin-8. The proteins of SEQ ID Nos: 393 and 405 contain four membrane-spanning segments.

The proteins of SEQ ID NOs: 391 and 407 represent novel isoforms of claudin-8. The protein of SEQ ID NO:391 (145-52-2-0-D12-CS) is 162 amino acids long, contains three predicted membrane-spanning segments, and has three amino acid substitutions (R31I, S151P and E162) with respect to the claudin-8 sequence (PF00822). The protein of SEQ ID NO:407 (174-38-4-0-D11-CS) is 43 amino-acids long. SEQ ID NO:407 contains a stop codon at position 44 and contains no predicted membrane-spanning segment. The proteins of SEQ ID NOs: 391 and 407 have novel function. The proteins of SEQ ID NOs: 391 and 407 do not have full claudin-8 function.

The Claudin family of proteins comprises more than twenty small glycoproteins with four predicted transmembrane domains. The tissue distribution pattern of claudins varies significantly, depending on claudin species. Many (including claudin-8) have been identified as components of tight junction (TJ) strands that play a role in regulation of cell permeability and polarity. Polarized epithelial and endothelial cells form barriers that separate biological compartments and regulate homeostasis. The TJ is a specialized membrane domain at the most apical region of polarized epithelial and endothelial cells that not only creates a primary barrier to prevent paracellular transport of solutes (barrier function) but also restricts the lateral diffusion of membrane lipids and proteins to maintain the cellular polarity. A relationship between claudin suppression and the alteration of TJ morphology is believed to correlate with the increase of endothelial permeability (Liebner S et al. Acta Neuropathol (Berl) 100(3):323–331 (2000) which disclosure is hereby incorporated by reference in its entirety).

In many intestinal (including inflammatory bowel disease and irritable bowel syndrome) and systemic diseases, intestinal barrier damage is marked by changes in intestinal permeability which are in turn related to alteration in TJ function (Gasbarrini G, Montalto Mital J Gastroenterol Hepatol 31(6):481–488 (1999) which disclosure is hereby incorporated by reference in its entirety). Permeability of the TJs can be modified by bacterial toxins, cytokines, hormones and drugs.

Claudins have also been implicated in malignancy. For example, down regulation of the expression of claudin has been associated with oncogenesis in rat salivary gland epithelium cells (Li D and Mrsny R J J Cell Biol 148(4) :791–800 (2000) which disclosure is hereby incorporated by reference in its entirety). The increase in microvascular permeability in human gliomas, contributing to clinically severe symptoms of brain edema, appears to be the result of a dysregulation of junctional proteins. Increased TJ permeability of the colon epithelium, and consequently a decrease in epithelial barrier function, precedes the development of colon tumors, including carcinomas and adenomatous polyps (Soler A P et al. Carcinogenesis 20(8):1425–1431 (1999) which disclosure is hereby incorporated by reference in its entirety). Studies of the interendothelial junctions in tumor microvessels of human glioblastoma multiforme show that the expression of claudin is lost in the majority of tumor microvessels.

Opening of TJs by environmental proteinases may be the initial step in the development of asthma to a variety of allergens. The lung epithelium forms a barrier that allergens must cross before they can cause sensitization. The cysteine proteinase allergen Der p1 from fecal pellets of *Dermatophagoides pteronyssinus* (the house dust mite (HDM) causes disruption of intercellular TJs, the principal components of the epithelial paracellular permeability barrier. TJ breakdown nonspecifically increases epithelial permeability, allowing Der p1 to cross the epithelial barrier. Putative Der p1 cleavage sites were found in peptides from an extracellular domain of claudin. HDM allergens are important factors in the increasing prevalence of asthma (Wan H et al. J Clin Invest 104(1):123–33 (1999) which disclosure is hereby incorporated by reference in its entirety).

In a preferred embodiment, the present invention provides for a method to use the proteins of SEQ ID NOs:391 and 407 for in vitro analysis of claudin-8 function. Further preferred is a method of using the proteins of SEQ ID NOs:391 and 407 for in vitro analysis of the impaired claudin-8 function of said proteins. Further preferred is a method of in vitro analysis of signaling function of the protein of SEQ ID NO:407. Further preferred is a method of in vitro analysis of signaling function of the protein of SEQ ID NO:407 as it relates to the activation or differentiation of non-epithelial cells. Further preferred is a method of in vitro analysis of signaling function of the protein of SEQ ID NO: 407 as it relates to the activation or differentiation of leukocytes, keratinocytes, and endothelial cells.

In a preferred embodiment, the present invention provides for a method to determine the expression of the novel claudin-8 isoforms corresponding to the proteins of SEQ ID NOs: 391 and 407. Further preferred is a method of determining expression of the proteins of SEQ ID NOs: 391 and 407 as it relates to the profiling (for purposes of diagnosis or classification) of pathologies. Further preferred is a method of determining expression of the proteins of SEQ ID NOs: 391 and 407 as it relates to the profiling of Crohn's disease, ulcerative colitis, irritable bowel syndrome, allergic asthma, gliobastoma, colorectal carcinoma, and adenomatous polyps. Further preferred is a method of using nucleic acid sequence corresponding to the proteins of SEQ ID NOs: 391 and 407, namely that comprising SEQ ID Nos: 150 and 166 respectively, to determine the expression of the proteins of SEQ ID NOs: 391 and 407 in said pathologies. Further preferred is a method wherein reverse transcription-polymerase chain reaction (RT-PCR) is used in said method to determine the expression of the proteins of SEQ ID NOs: 391 and 407 in said pathologies. The methods of design of such RT-PCR analysis are known by those skilled in the art.

In a preferred embodiment, the present invention provides for a method in which the proteins of SEQ ID Nos: 391, 393, 405 and 407, or biologically active fragments thereof, are used to treat asthma or reduce the incidence of asthmatic attacks. Further preferred are compositions comprised of the proteins of SEQ ID Nos: 391, 393, 405 and 407, or biologically active fragments thereof. Further preferred are formulation of said compositions that are compatible with therapeutic administration as an aerosol. Further preferred is a method wherein purified fragments or synthetically modified peptides derived from the extracellular domains of the proteins of SEQ ID Nos: 391, 393, 405 and 407 are administered in the said therapeutic regimen. Further preferred embodiment is a method of using said peptides wherein the peptides contain the putative cleavage sites for environmental allergen proteinases and wherein said peptides are administrated in amounts that competitively inhibit the proteinase activity of the allergen. Further preferred is a method of using said peptides in said treatment of asthma wherein the peptides are designed to bind inhibit allergen proteinase irreversibly.

The negative effects of the usual preservation solutions on epithelial and endothelial permeability in organs to be transplanted are generally known (Trocha S. D. et al. Ann.Surg. 230: 105–113 (1999) which disclosure is hereby incorporated by reference in its entirety). Increases in permeability lead to tissue injury and edema. Disorganization of TJ proteins appears to be responsible for the observed tissue injury and edema. In a preferred embodiment, the present invention provides for a method in which the proteins of SEQ ID Nos: 391, 393, 405 and 407, or biologically active fragments thereof, are used to maintain the content and integrity of TJs in organs to be transplanted. Further preferred embodiment is a method of using the proteins of SEQ ID Nos: 391, 393, 405 and 407, or biologically active fragments thereof, as constituents of the preservation solutions in order to improve the quality of said organs to be transplanted.

Claudins are unique proteins with specific protein-binding properties. In a preferred embodiment, the present invention provides for the use of the proteins of SEQ ID Nos: 391, 393, 405 and 407, or biologically active fragments thereof, as a component of drug delivery vehicles such as colloids or liposomes. Further preferred embodiment is the use of proteins of SEQ ID Nos: 391, 393, 405 and 407, or biologically active fragments thereof, in a method of specifically targeting therapeutic agents to epithelial cells. Further preferred is a method wherein the incorporation of the proteins of SEQ ID Nos: 391, 393, 405 and 407, or biologically active fragments thereof, into liposomes is used to specifically targent therapeutic agents carried by the liposomes to epithelial cells. The methods of design of such type of drug delivery systems is known by those skilled in the art (Smith H. J., Introduction to the principles of drug design and action, $3^{rd}$ ed. (1998) which disclosure is hereby incorporated by reference in its entirety). In a further preferred embodiment, the proteins of SEQ ID NOs: 391, 393, 405 and 407, or biologically active fragments thereof, are directly conjugated (either recombinantly or by using chemically active agents) to chemotherapeutic agents, radioisotopes, or prodrugs and said conjugate subsequently used in therapeutic regimens.

In further preferred embodiment, the present invention provides for a method of producing "bioartificial" epithelia from non-epithelial cells. The "bioartificial" epithelia produced according to the invention may be used for reconstructive surgical procedures, for treating of disorders related to epithelial loss (for hereditary, traumatic or oncological reasons) or for another therapeutic purposes (for example, burn treatments). Further preferred is a method of using the nucleic acids corresponding to the proteins of SEQ ID Nos: 391, 393, 405 and 407 wherein "bioartificial" epithelial cells are obtained by transfection of said nucleic acid, and consequential remodeling, of the patient's autologous cells not affected by any of said disorders. The use of autologous cells in the preparation of the "bioartificial" epithelial cells of the invention in methods of treating disorders, conditions, or diseases associated with the loss of epithelial cells reduces or eliminates the risk of tissue rejection typically observed in transplantation methodologies. Methods of bioartificial tissue engineering are generally known to those skilled in the art (for a review, see Machens H. G. et al. Cells Tissues Organs 167: 88–94 (2000) which disclosure is hereby incorporated in its entirety by reference).

The intestinal epithelium is a major barrier to the absorption of hydrophilic drugs. The presence of intercellular junctional complexes, particularly the TJs, renders the epithelium impervious to hydrophilic drugs, which cannot diffuse across the cells through the lipid bilayer of the cell membranes (Ward P D et al., Pharmaceutical Science and Technology Today 3:10:346–358 (2000) which disclosure is hereby incorporated by reference in its entirety). Therefore, in further preferred embodiment, the present invention provides for a method of using the proteins of SEQ ID NOs: 391, 393, 405 and 407, or biologically active fragments thereof, to increase the intestinal absorption of said hydrophilic drugs by increasing the paracellular permeability for said drugs. Preferred compositions of the proteins of SEQ ID NOs: 391, 393, 405 and 407, or biologically active fragments thereof, are those compatible with oral administration. In other preferred embodiment, the present invention provides for a method of using antisense polynucleotides corresponding to the proteins of SEQ ID NOs: 391, 393, 405 and 407 to down-regulate expression of said proteins. Further preferred is a method wherein said antisense polynucleotides are used to temporally increase epithelial permeability for therapeutic ends including but not limited to increasing the efficiency of drug delivery. Methods of designing, synthesizing, and using said antisense polynucleotides are well known to those skilled in the art.

In further preferred embodiment, the present invention provides for an antibody that specifically binds the novel isoforms of claudin-8 corresponding to the proteins of SEQ ID NOs: 391 and 407. Further preferred is a method of making said polyclonal antibody by immunization of a rabbit with said proteins or any fragments thereof. Methods of generating said polyclonal antibodies and of establishing their specificity are well known to those skilled in the art. Methods of establishing specificity are well known to those skilled in the art and include but are not limited to immunoprecipitation, Western blot analysis, and protein sequencing of immunoprecipitated material.

Further preferred is a method of making said antibody by immunization of a mouse with a syngeneic cell line over-expressing protein of SEQ ID NO:391 or with purified recombinant protein of SEQ ID NO:407. Methods of preparing said recombinant proteins are well known to those skilled in the art. Further preferred is a method of making a monoclonal antibody from said immunization of a mouse with a syngeneic cell line over-expressing protein of SEQ ID NO:391 or with purified recombinant protein of SEQ ID NO:407. Further preferred is a method of making a monoclonal antibody from said immunization of a mouse with a syngeneic cell line over-expressing protein of SEQ ID NO:391 or with purified recombinant protein of SEQ ID NO:407. Further preferred is a method of identifying SEQ ID NO:391-specific and SEQ ID NO:470-specific monoclonal antibodies by differential screening on a syngeneic cell line over-expressing protein of SEQ ID NO:391 or on purified recombinant protein of SEQ ID NO:407, respectively, versus a syngeneic cell line over-expressing human claudin-8 protein. Methods of generating said monoclonal antibodies and of establishing specificity are well known to those skilled in the art. Methods of establishing specificity are well known to those skilled in the art and include but are not limited to immunoprecipitation, Western blot analysis, and protein sequencing of immunoprecipitated material.

Further preferred is a method of contacting said polyclonal or monoclonal antibody with the proteins of SEQ ID NOs: 391 and 407. Further preferred is a method of using said antibody to isolate said proteins from either natural or recombinant sources. Further preferred is a method of using said antibody to determine the level of expression of said proteins within bodily fluids or tissues. Further preferred is a method of using said antibody to isolate said proteins from bodily fluids or tissue preparatory to in vitro analysis of in vivo modifications of said proteins. Further preferred is a method of using said antibody to determine the level of expression of said proteins as it relates to the diagnosis or classification of pathologies. Further preferred is a method of using said antibody to determine the level of expression of said proteins as it relates to the diagnosis or classification of Crohn's disease, ulcerative colitis, irritable bowel syndrome, allergic asthma, gliobastoma, colorectal carcinoma, and adenomatous polyps. Further preferred is a method of using said antibody to investigate regulation of the level of SEQ ID NO:391 or SEQ ID NO:470 protein expression in response to the proinflammatory factors tumor necrosis factor-alpha (TNF-alpha), interleukin-1 beta (IL-1 beta), interleukin-8 (IL-8), and complement factor 5a (C5a).

Further preferred is a method to use a humanized version of the aforementioned SEQ ID NO:391 or SEQ ID NO:470 monoclonal antibody in a method to treat impaired claudin-8 function. Further preferred is a method of using said antibody to up-regulate claudin-8 function in associated pathologies Crohn's disease, ulcerative colitis, irritable bowel syndrome, allergic asthma, gliobastoma, colorectal carcinoma, and adenomatous polyps. Preferred composition is the said antibody. Preferred formulations are those amenable to the administration by injection or, in the case of allergic asthma, administration by aerosol.

Further preferred is a method wherein said humanized monoclonal antibodies are used to temporally increase epithelial permeability for therapeutic ends including but not limited to increasing the efficiency of drug delivery, analogous to that discussed above. Preferred formulations are those comprising said antibody that are compatible with oral delivery.

The invention further relates to a method of screening libraries of compounds for test compounds that specifically bind to the proteins of SEQ ID NOs: 391 and 407 (obtained from either natural or recombinant sources), or fragments thereof, and either suppress or enhance claudin-8 function in said proteins. The proteins of SEQ ID NOs: 391 and 407 that are employed in such screening are either free in solution, affixed to a solid support, recombinantly expressed on or chemically attached to a cell surface, or positioned intracellularly. The formation of binding complexes between said protein of interest and the compound being tested may be measured by methods well known to those skilled in the art. Proteins of SEQ ID NOs:247 and 246 (Internal Designations 105-031-2-0-D3-CS and 105-031-1-0-A2-CS)

The protein of SEQ ID NOs:247 and 246, encoded by the cDNAs of SEQ ID NOs: 6 and 5, respectively, are overexpressed in liver, pancreas, and prostate. The proteins of the invention are strongly homologous to the human membrane-bound protein PRO836 (GENSEQP accession number: W63687), and to the human secreted protein 7 (GENSEQP accession number: Y57941). The proteins of the invention also share homology with the chaperone-associated protein, SLS1p, found in yeast Yarrowia lipolytica (GENPEPT accession number Z50154), having 27% identity from amino-acids 68 to 340 of protein of SEQ ID No: 247. In addition, the proteins of SEQ ID NOs: 247 and 246 share homology with two Hsp70 family proteins, Hsp-binding protein 1 found in mice (GENSEQP accession number: Z50154), and human species (GENPEPT accession number: AF093420), and Hsp-binding protein 2 found in human species (GENPEPT accession number: AF1 87859).

The proteins of the invention are related to a yeast lumen protein of the endoplasmic reticulum, SLS1p. This protein acts in the preprotein translocation process, interacting directly with translocating polypeptides to facilitate their transfer and/or help their folding in the endoplasmic reticulum (Boisrame et al. J Biol Chem 1996; 271:11668–75). In addition, Sls1p is believed to act as a cofactor of the chaperon protein Kar2 (Boisrame et al. J Biol Chem 1998; 273:30903–8; Kabani et al. Gene 2000; 241:309–15). Thus, the proteins of the invention are presumed to have similar cellular functions as those of chaperones. Such functions include a number of cellular processes, such as protein folding, disassembly of oligomeric protein structures, regulation of apoptosis, protein degradation, protein translocation in the endoplasmic reticulum, and antigen-presentation (Bukau et al. Cell 1998; 92:351–66). Chaperones are also involved in a number of disorders, especially autoimmune diseases such as type 1 diabetes, rheumatoid arthritis, systemic lupus erythematosus, Sjogren syndrome, and mixed connective tissue disease (Feige et al. EXS 1996; 77:359–73; Feili-Hariri et al. J Autoimmun 2000; 14:133–42). Chaperones are also involved in various disorders including tuberculosis and leprosy (Zugel et al. Clin Microbiol Rev 1999; 12:19–39), neurogenerative disorders such as Alzheimer and Parkinson diseases (Yoo et al. J Neural Transm Suppl 1999; 57:315–22), and malignant disorders (Csermely et al. Pharmacol Ther 1998; 79:129–68). In addition, a growing body of evidence suggests the involvement of the Hsp60 chaperone in the development of atherosclerosis (Xu et al. Circulation 2000; 102:14–20). Thus, the present proteins, which are presumed to be co-factors of a chaperon as summarized above, are believed to have analogous cellular functions and to be involved in similar pathological processes.

In one embodiment, the present invention provide methods of using the present proteins to identify specific cell types in vitro and in vivo. For example, as chaperone proteins are often upregulated in response to cellular stress, the detection of cells expressing elevated levels of the proteins provides a tool for detecting cells under stress. As cellular stress has been implicated in a number of disorders, such as cardiovascular disorders, neurodegenerative disorders, and cancer, the ability to detect such stress thus provides a diagnostic or screening tool for such conditions. In addition, the present polypeptides and polynucleotides can be used to identify liver, pancreas, and prostate tissues, and cells derived from these tissues. The ability to specifically visualize such tissues and cells is useful for a number of applications, including to determine the origin or identity of, e.g. cancerous cells, as well as to facilitate the identification of particular cells and tissues for, e.g. the evaluation of histological slides.

In addition, the present polypeptides and polynucleotides can be used to develop diagnostic and screening assays for diseases characterized by an abnormal level or activity of the protein of SEQ ID NOs:247 and 246. Such disorders include, but are not limited to, infectious diseases, neurogenerative disorders such as Alzheimer's and Parkinson's diseases, schizophrenia, alopecia, aging, atherosclerosis, malignant disorders of various types, and autoimmune diseases including type 1 diabetes, rheumatoid arthritis, systemic lupus erythematosus, Sjogren syndrome, and mixed connective tissue disease. Such assays can be performed using any biological sample, such as serum or plasma.

In still another embodiment, the proteins of the invention or part thereof can be used to prevent cells from undergoing apoptosis. Specifically, as chaperone proteins have been shown to protect cells from apoptosis, any method of increasing the level or activity of the present protein can be used to prevent cells from undergoing apoptosis, in vitro or in vivo. For example, a polynucleotide encoding a protein of SEQ ID NO:247 or 246, or any fragment or derivative thereof, can be introduced into cells, e.g. in a vector, wherein the protein is expressed in the cells. Alternatively, a protein of SEQ ID NO:247 or 246 itself can be administered to cells, preferably in a formulation that leads to the internalization of the protein by the cells. Also, any compound that increases the expression or activation of the proteins within the cells can be administered. Preventing cells from undergoing apoptosis can be used for any of a large number of purposes, including, but not limited to, to prevent the death of cells being grown in culture, to prevent in a patient the apoptosis associated with any of a number of disorders, or to prevent apoptosis in cells of a patient undergoing a treatment that increases the level of cellular stress, such as chemotherapy.

In another embodiment, inhibiting the proteins of the invention can be used to induce apoptosis in undesired cells. Such inhibition can be accomplished in any of a number of ways, including, but not limited to, using antibodies, antisense sequences, dominant negative forms of the protein, or small molecule inhibitors of the expression or activity of the proteins. Such induction of apoptosis can be used to eliminate any undesired cells, for example cancer cells, in a patient. Preferably, such inhibitors are targeted specifically to the undesired cells in the patient.

In another embodiment, various disorders can be treated, attenuated and/or prevented by a protein of SEQ ID NOs:247 or 246, or part thereof, or any other compound that can affect the level or activity of the proteins such as nucleic acids, antibodies, or chemical substances. In a preferred embodiment, proteins or other compounds directed to the proteins of the invention can be used to treat or prevent disorders in which the activity or level of the proteins of SEQ ID NO:247 or 246 is unbalanced. Such diseases include, but are not limited to, infectious diseases, neurogenerative disorders as Alzheimer and Parkinson diseases, schizophrenia, alopecia, aging, atherosclerosis, malignant disorders of various types, and autoimmune diseases including type 1 diabetes, rheumatoid arthritis, systemic lupus erythematosus, Sjogren syndrome, mixed connective tissue disease, malignant disorders, autoimmune and any other neurodegenerative disorder. In another embodiment, the proteins of SEQ ID NO:247 or 246 or part thereof can be used as vaccines for various disorders including, but not limited, to cancer (Wang et al. Immunol Invest 2000;29:131–7), tuberculosis (Silva et al. Microbes Infect 1999;1:429–35), diabetes (Int Immunol 1999;11:957–66), and atherosclerosis (Xu et al. Arterioscler Thromb 1992;12:789–99).

Protein of SEQ ID NO:389 (Internal Designation 109-003-1-0-G4-CS)

The protein of SEQ ID NO:389 is encoded by the cDNA of SEQ ID NO:148. Accordingly, it will be appreciated that all characteristics and uses of the polypeptide of SEQ ID NO:389 described throughout the present application also pertain to the polypeptide encoded by the human cDNA of clone 109-003-1-0-G4-CS. In addition, it will be appreciated that all characteristics and uses of the nucleic acid of SEQ ID NO:148 described throughout the present application also pertain to the human cDNA of clone 109-003-1-0-G4-CS. The protein of SEQ ID NO:389 is highly homologous to two human proteins encoded by genes listed in Genbank under accession numbers AF143723 and AF112210, the disclosures of which are incorporated herein by reference in their entireties.

The polypeptide encoded by Genbank accession numbers AF143723 and AF112210 belong to the Hsp70 protein family (even though one of them has erroneously been attributed to the related Hsp60 family). Many genes encoding "Hsps" (heat shock proteins) have been cloned and sequenced, including, for example, human hsp70 (GenBank Accession Nos. M11717 and M15432; see also Hunt and Morimoto, 1985, Proc. Natl. Acad. Sci. USA 82: 6455–6459, the disclosures of which are incorporated herein by reference in their entireties), human hsp90 (GenBank Accession No. X15183; see also Yamazaki et al., 1989, Nucleic Acids Res. 17: 7108, the disclosures of which are incorporated herein by reference in their entireties), and human gp96 (GenBank Accession No. M33716; see also Maki et al., 1990, Proc. Natl. Acad. Sci. USA 87: 5658–5662, the disclosures of which are incorporated herein by reference in their entireties).

The protein of SEQ ID NO:389 and the two homologs mentioned above are actually closer to yeast members of the family than to the human Hsp70, which makes the corresponding genes previously unidentified human members of the family. Both the Pfam and Prosite Hsp70 signatures (respectively the "HSP70" Pfam model from amino acid position 3 to 509 and the PS01036 Prosite motif from position 332 to 346) are recognized within the protein of SEQ ID NO: 389. The protein of SEQ ID NO:389 differs from the protein encoded by AF112210 at amino-acid positions 282, 312 and 326, and from the protein encoded by AF143723 at amino acid position 15 and 326.

Heat shock proteins are a family of molecular chaperone proteins which have long been known to play essential roles in a multitude of intra-and intercellular processes, including protein synthesis and folding, vesicular trafficking, and antigen processing and presentation. Hsps are among the most highly conserved proteins known, and carry out many of their regulatory activities via protein-protein interactions. Historically they were identified by induction under conditions of stress, during which they are now known to provide an essential action of preventing aggregation and assisting refolding of misfolded proteins. The major stress proteins accumulate to very high levels in stressed cells but occur at low to moderate levels in cells that have not been stressed.

Hsp70 is one member of the heat shock protein family. (Milner, C. M. and Campbell, R. D. Immunogenetics 32: 242–251 (1990); Genbank Accession No. M59828, the disclosures of which are incorporated herein by reference in their entireties). The 70kD heat shock protein is a highly conserved, ubiquitous protein involved in chaperoning proteins to various cellular organelles. Contrary to other members of the Hsp family, it is highly inducible in mammals. Although Hsp70 is barely detectable at normal temperatures, it becomes one of the most actively synthesized proteins in the cell upon heat shock (Welch et al., 1985, J. Cell. Biol. 101:1198–1211, the disclosure of which is incorporated herein by reference in its entirety). In contrast, the Hsp90 and Hsp60 proteins are abundant at normal temperatures in most, but not all, mammalian cells and are further induced by heat (Lai et al., 1984, Mol. Cell. Biol. 4:2802–10; van Bergen en Henegouwen et al., 1987, Genes Dev., 1:525–31, the disclosures of which are incorporated herein by reference in their entireties). Furthermore the Hsp70 proteins act as monomers whereas the functionally related Hsp60 proteins are associated in vivo within large double ring assemblies of nearly a million daltons. The various actions of the Hsps all rely basically on their ability to complex polypeptide segments, preferrably hydrophobic, and to stabilize them in an extended conformation in an ATP-dependent manner. The complexed polypeptides can be antigenic peptides (in which case the Hsps help directing them to the major histocompatibility complexes for presentation) or misfolded proteins which are facilitated to adopt the proper conformation by repeated cycles of binding to Hsps followed by release/refolding (see Bukau, B. and Horwich L., 1998, Cell 92: 351–366, the disclosure of which is incorporated herein by reference).

On the basis of the above information, it is believed that the protein of SEQ ID NO:389 is a member of the human Hsp70 family. Accordingly, the protein of SEQ ID NO:389 may play a role in protein synthesis/folding, cellular trafficking, antigen processing, the cellular stress response and the immune response in immuno-competent cell types. Additional information regarding the protein of SEQ ID NO:389 may be obtained by performing a binding assay with a consensus Hsp70 substrate using the methods described in Rüdiger et al., 1997, EMBO J. 16, 1501–1507, the disclosure of which is incorporated herein by reference in its entirety.

One embodiment of the present invention relates to methods of using the protein of SEQ ID NO:389 or fragments comprising at least 5, 8, 10, 12, 15, 20, 25, 30, 35, 40, 50, 60, 75, 100, 150, or 200 consecutive amino acids thereof, or fragments having a desired biological activity as a stabilizing adjuvant to slow down protein degradation, boost the yields of recombinant proteins or regenerate denatured proteins. In such an embodiment, the protein of SEQ ID NO:389 of fragment thereof is mixed with a composition comprising the protein for which it is desired to slow down degradation, boost yield, or regenerate denatured proteins under conditions which facilitate the desired result.

For example, numerous commercial assay kits commonly used by those skilled int the arts of molecular biology and biochemistry depend on the biological properties of proteins (mostly enzymes) which can be very short-lived in vitro due to the low stability of those proteins. An example is described in Eur. Patent DE4124286, the disclosure of which is incorporated herein by reference in its entirety, wherein the low intrinsic stability of test solutions used in optical tests is increased by addition of chaperone proteins, thus making the test more sensitive.

The protein of SEQ ID NO:389 may also be used to increase the yield or activity of recombinant proteins. In recombinant DNA technology, a major unsolved problem is the solubility and biological activity of the recombinantly overexpressed protein in a host, especially a bacterial or yeast host. Many eukaryotic proteins, especially the secreted ones, require for correct folding a specific cellular machinery which is lacking in bacterial hosts such as *E. coli* or becomes insufficient in mammalian/yeast cells due to high expression of the protein. The ability of the protein of SEQ ID NO:389 or fragments thereof to ensure proper folding of recombinant proteins may be utilized as follows. The protein of SEQ ID NO:389, may be coexpressed with the recombinant protein in bacterial or eukaryotic hosts to cause the hosts to express the heterologous proteins or polypeptides in a form having increased solubility and/or biological activity. For example, the protein of SEQ ID NO:389 or fragments thereof may be used in the methods described in PCT application WO 93/25681, the disclosure of which is incorporated herein by reference in its entirety. Alternatively the protein of SEQ ID NO:389 or fragments thereof may be exogeneously added to the cell cultures as described in PCT application WO 00/08135, the disclosure of which is incorporated herein by reference in its entirety. Indeed PCT application WO 00/31113, the disclosure of which is incorporated herein by reference in its entirety, shows that when added exogenously to cells, Hsp70 is readily imported into both cytoplasmic and nuclear compartments. Preparation and purification of the protein of SEQ ID NO:389 or fragments thereof may be carried out as described in U.S. Pat. No. 6,007,821, the disclosure of which is incorporated herein by reference in its entirety.

The protein of SEQ ID NO:389 or fragments thereof. may further be used to regenerate denatured proteins. Recombinantly expressed proteins with poor biologival activity are routinely denatured with a potent denaturing agent, such as guanidine hydrochloride, followed by refolding by dilution with a large amount of a diluent to reduce the concentration of the denaturing agent. However, this method often results in a poor refolding rate which may be significantly increased by addition of a cocktail of chaperone proteins in a fashion similar to that described for Hsp60 in Eur. Patent EP0650975, the disclosure of which is incorporated herein by reference in its entirety. The advantage of using a cocktail of chaperone proteins is to accommodate differences in binding specificity of the Hsp different families and the different members within each family. For instance, vertebrate actin is efficiently folded by the chaperonine of the eukaryotic cytosol (Gao et al., 1992, Cell 69:1043–1050, the disclosure of which is incorporated herein by reference in its entirety) but not at all by Hsp60 (Tian et al., 1995, Nature 375:250–253, the disclosure of which is incorporated herein by reference in its entirety).

Another embodiment of the present invention relates to the use of the protein of SEQ ID NO:389 or fragments thereof to deliver heterologous compounds (proteins, peptides, or DNA) to specific cellular compartments, preferably the cytoplasm and the nucleus. If desired, the protein of SEQ ID NO:389 or a fragment thereof may be fused to the heterologous compound. For example, the protein of SEQ ID NO:389 or fragments thereof may be used to chaperone compounds into cells using the methods described in PCT application WO 00/31113, the disclosure of which is incorporated herein by reference in its entirety. In the methods described in WO 00/3113, Hsp70 was used to deliver NF-KB, a key transcriptional regulator of inflammatory responses, into the nuclear compartment. It was shown that a fusion protein composed of a Cterminal Hsp70 peptide and amino acids 37–409 of the p50 subunit of NF-KB was directed into the nucleus of cells, could bind DNA specifically, and activated kappa Ig expression and TNFa production.

In one embodiment of the present invention, the protein of SEQ ID NO:389 or a fragment thereof may be used in human therapy as a modulator of immune response. Disease states which may be treated by Hsp70, fragments thereof, and/or Hsp70 complexes of the present invention include transplant rejection (see U.S. Pat. No. 5,891,653, the disclosure of which is incorporated herein by reference in its entirety) and autoimmune diseases, such as insulin dependent diabetes mellitus, rheumatoid arthritis, multiple sclerosis, juvenile diabetes, asthma, and inflammatory bowel disease, as well as inflammatory diseases, cancer, viral replication diseases and vascular diseases as described in the following patents, each of which is incorporated herein by reference in its entirety: U.S. Pat. No. 6,007,821; WO 00/31113; WO 99/18801 (treatment of auto-immune diseases), U.S. Pat. Nos. 6,017,540; 6,017,544; AU3425899; WO 99/54464; U.S. Pat. Nos. 5,837,251; 5,830,464; WO 98/34642; WO 98/34641; U.S. Pat. No. 5,750,119; WO 97/10001; WO 96/10411(cancer treatment); DE19813760, DE19813759 (both autoimmune disease and cancer).

The protein of SEQ ID NO:389 or fragments thereof may also be used to treat or ameliorate autoimmune disease. In this embodiment, compositions of complexes of heat shock/stress proteins (including, but not limited to the protein of SEQ ID NO:389) are administered to an individual suffering from an autoimmune disease. The complexes may be comprised of the protein of SEQ ID NO:389 or fragments thereof alone or may include other heat shock/stress proteins. In one embodiment, the protein of SEQ ID NO:389 or a fragment thereof is bound noncovalently to antigenic molecules and administered to individuals suffering from autoimmune disease to suppress the autoimmune response. Alternatively, compositions comprising the protein of SEQ ID NO:389 or fragments thereof in an un-complexed form (i.e., free of antigenic molecules) may also be administered to an individual suffering from autoimmune disease to suppress the immune response (see U.S. Pat. No. 6,007,821, the disclosure of which is incorporated herein by reference in its entirety).

The ability of stress proteins to chaperone the antigenic peptides of the cells from which they are derived allows them to be used to isolate the antigenic peptides expressed in a tumor. In this embodiment of the present invention, complexes comprising the protein of SEQ ID NO:389 or fragments thereof and an antigenic peptide expressed by the tumor are isolated. The isolated complexes are administered back to the individual from which they were obtained in order to elicit an immune response against the tumor. Accordingly, this approach circumvents the necessity of isolating and characterizing specific tumor antigens and enables the skilled artisan to readily prepare immunogenic compositions effective against a tumor in an individual (see U.S. Pat. No. 6,017,544, the disclosure of which is incorporated herein by reference in its entirety).

The protein of SEQ ID NO:389 may also be used to diagnose bladder cancer. The segment of the protein of SEQ ID NO:389 extending between amino acid positions 1 through 187 is more than 99% identical to a polypeptide which is linked to bladder cancer. (See Eur. Patent DE19818620, the disclosure of which is incorporated herein by reference in its entirety). The 187 amino-acid long polypeptide described in DE19818620 was identified as the partial product of the only gene for which expression was significantly altered in a bladder tumour compared to a healthy bladder. In another embodiment of the present invention, the protein of SEQ ID NO:389 or a fragment thereof thereof may be used to diagnose disorders associated with altered intercellular communication or secretion. In such techniques, the level of the protein of SEQ ID NO:389 in an individual is measured using techniques such as those described herein. The level of the protein of SEQ ID NO:389 in the individual is compared to the level in normal individuals. An altered level of the protein of SEQ ID NO:389 relative to normal individuals suggests that the individual is suffering from bladder cancer. The level of the protein of SEQ ID NO:389 present in the individual may determined by contacting a sample from the individual with an antibody directed against the polypeptide of SEQ ID NO:389. Alternatively, the level of the protein of SEQ ID NO:389 in the individual may be measured by determining the level of RNA encoding the protein of SEQ ID NO:389 in the sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the sample is compared to RNA levels in normal individuals to determine whether the individual is suffering from bladder cancer.

Antibodies against the protein of the protein of SEQ ID NO:389 or nucleic acid probes complementary to the sequence encoding the protein of SEQ ID NO:389 may also be used as a prognosis of tumor recurrence in breast as described in patent U.S. Patent No.: U.S. Pat. No. 5,188,964, the disclosure of which is incorporated herein by reference in its entirety. As described in U.S. Pat. No. 5,188,964, specific levels of the stress response proteins (including Hsp70) were identified, above which the probability of tumor recurrence is highly signficant. Accordingly, the levels of the protein of SEQ ID NO:389 or RNA encoding the protein of SEQ ID NO:389 may be determined from in a sample from an individual who has experienced a breast tumor in the past. Protein or RNA levels may be measured as described herein. If the protein or RNA levels exceed the levels above which tumor occurrence is likely, an appropriate course of treatment may be initiated.

In another embodiment of the present invention, the protein of SEQ ID NO:389 may be used to promote tissue repair and/or increase cell survival in stress conditions such as hypoxy, oxidative stress, genotoxic agents and more generally harmful conditions leading to programmed cell death. The beneficial effect is produced either by protecting the cell proteins from premature denaturation/degradation or by directly inhibiting a signal transduction pathway leading to programmed cell death (Gabai V L. et al., 1998, FEBS Lett. 438:1–4, the disclosure of which is incorporated herein by reference in its entirety). Those conditions include but are not limited to infarction, heart surgery, stroke, neurodegenerative diseases, epilepsy, trauma, atherosclerosis, restenosis after angioplasty, and nerve damage. For example, it is known that hypoxic stress is a signal that increases the amount of Hsp70 in cardiac tissue, whereupon Hsp70 helps cells survive by binding to partially denatured proteins and assisting in the refolding of these proteins into more stable native structures. Such assistance would be extremely important in providing protection to the heart during periods of hypoxia such as during an infarct or during surgery when blood flow to the heart may be temporarily halted. Several groups have also shown that overproduction of Hsp70 leads to protection in several different models of nervous system injury (reviewed in Midori A Y et al., 1999, Mol. Med. Today, 5:525–31, the disclosure of which is incorporated herein by reference in its entirety). Therapeutic methods for administering the protein of SEQ ID NO:389 or a fragment thereof include but are not limited to those disclosed in Patent WO 00/23093, the disclosure of which is incorporated herein by reference in its entirety.

Accordingly, it may be desirable to increase or decrease the level of the protein of SEQ ID NO:389 in an individual having a condition resulting from an increased or decreased level of the protein. In such embodiments, the protein of SEQ ID NO:389, or a fragment thereof, is administered to an individual in whom it is desired to increase or decrease any of the foregoing activities. The protein of SEQ ID NO:389 or fragment thereof may be administered directly to the individual or, alternatively, a nucleic acid encoding the protein of SEQ ID NO:389 or a fragment thereof may be administered to the individual. Alternatively, an agent which increases the activity of the protein of SEQ ID NO:389 may be administered to the individual. Such agents may be identified by contacting the protein of SEQ ID NO:389 or a cell or preparation containing the protein of SEQ ID NO:389 with a test agent and assaying whether the test agent increases the activity of the protein. For example, the test agent may be a chemical compound or a polypeptide or peptide.

Alternatively, the activity of the protein of SEQ ID NO:389 may be decreased by administering an agent which interferes with such activity to an individual. Agents which interfere with the activity of the protein of SEQ ID NO:389 may be identified by contacting the protein of SEQ ID NO:389 or a cell or preparation containing the protein of SEQ ID NO:389 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

Protein of SEQ ID NO:250 (Internal Designation 105-053-4-0-E8-CS)

The protein of SEQ ID NO:250 is encoded by the cDNA of SEQ ID NO:9. It will be appreciated that all characteristics and uses of the polypeptide of SEQ ID NO:250 described throughout the present application also pertain to the polypeptide encoded by the human cDNA of clone 105-053-4-0-E8-CS. In addition, it will be appreciated that all characteristics and uses of the nucleic acid of SEQ ID NO:9 described throughout the present application also pertain to the human cDNA of clone 105-053-4-0-E8-CS. The protein of SEQ ID NO:250 is found in prostate and exhibits extensive homologies to stretches of pancreatic zymogen granule membrane protein GP2 (Glycoprotein-2). In particular, the protein of SEQ ID NO:250 exhibits homologies to the GP2 proteins of human (SWISS-PROT accession number P55259, the disclosure of which is incorporated herein by reference in its entirety), rat (SWISS-PROT accession number P19218, the disclosure of which is incorporated herein by reference in its entirety) and dogs (SWISS-PROT accession number P25291, the disclosure of which is incorporated herein by reference in its entirety). In fact, the amino acid sequence of SEQ ID NO:250 is completely identical to those of human GP2 sequences except that the protein of SEQ ID NO:250 is missing amino acids 62 to 484 from the human GP2 sequence. The protein of SEQ ID NO:250 contains two hydrophobic regions, namely the N-terminal signal peptide (amino acid residues 8–28) and the C-terminal transmembrane domain (amino acid residues 91–111).

GP2 (Glycoprotein-2) is the major membrane glycoprotein of secretory zymogen granule (ZG) membranes within pancreatic acinar cells (Fukuoka et al. 1990 Nuc. Acids Res., 18:5900; Fukuoka et al. 1991 Proc. Natl. Acad. Sci., USA, 88:2898–2902; Fukuoka et al. 1992 Proc. Natl. Acad. Sci. USA, 89:1189–1193; Freedman, et al. 1993 Eur. J. Cell Biol. 61:229–238; Scheele et al. 1993 Pancreas :139–149; Freedman et al. 1994 Annals N.Y. Acad. Sci. 713:199–206, the disclosures of which are incorporated herein by reference in their entireties). GP2 homologues are also widely distributed among diverse epithelial tissues known to possess regulated secretory processes, including parotid, submandibular gland, stomach, liver and lung (Fukuoka et al. 1992 Proc. Natl. Acad. Sci. USA, 89:1189–1193).

In addition to ZG membranes, GP2 is also located in pancreatic acinar cells in rough endoplasmic reticulum, Golgi, trans-Golgi components, condensing vacuoles, apical plasma membranes (APM), basolateral plasma membranes (BPM), and within ZGs and acinar lumina (Scheele et al., 1994 Pancreas 9:139–149). GP2 is linked to the membrane of the ZG via a glycosylphosphatidyl inositol-anchor (GPI-anchor) (Fukuoka et al. 1991 Proc. Natl. Acad. Sci. USA, 88:2898–2902; Lebel and Beattie 1988 Biochem. Biophys. Res. Comm. 254:1189–93, the disclosures of which are incorporated herein by reference in their entireties) and forms complexes, usually tetrameric complexes, below a pH of about 6.5.

During assembly of secretory granules within the trans-Golgi network (TGN), the low pH of the TGN causes formation of GP2 complexes. These complexes bind to proteoglycans (PG), forming a fibrillar GP2/PG meshwork on the lumenal surface of the ZG. The GP2/PG matrix may function in membrane sorting within the TGN, assembly of ZG membranes, inactivation of ZG membranes during granule storage, and regulation of ZG membrane trafficking at the apical plasma membrane. The GP2/PG matrix may also protect the lumenal aspect of the granule membrane from contact with secretory enzymes contained within the granules and facilitate the specific release of secretory enzymes during exocytosis at the apical plasma membrane.

The enzymes and the acidic milieu contained in the ZG are released into the lumen of the pancreas through exocytosis by acinar cells. The pH at the apical plasma membrane of the acinar cells, and of the pancreatic lumen in general, is maintained at an essentially neutral or alkaline pH by the fluid and bicarbonate secreted by pancreatic ductal cells. The increased pH at the apical plasma membrane (relative to the acidic pH within the ZG) optimizes the conditions for enzymatic cleavage of the GPI anchor of GP2, resulting in release of GP2 and GP2/PG complexes from the apical membrane. (Scheele et al. (1994) Pancreas 9:139–149, the disclosure of which is incorporated herein by reference in its entirety). The form of GP2 produced by GPI-anchor cleavage is termed globular GP2 (gGP2).

It is believed that the protein of SEQ ID NO:250 is a GP2 protein, and is thus likely involved in regulated membrane trafficking along apical secretory processes in a variety of epithelial cells.

Accordingly, the present invention includes the use of the protein of SEQ ID NO:250, fragments comprising at least 5, 8, 10, 12, 15, 20, 25, 30, 35, 40, 50, 60, 75, 100, 150, or 200 consecutive amino acids thereof, or fragments having a desired biological activity in the modulation of membrane sorting within the trans-Golgi network, assembly of zymogen granule membranes, inactivation of zymgogen granule membranes during granule storage, regulation of zymogen granule membrane trafficking at the apical plasma membrane, release of secretory enzymes during exocytosis at the apical plasma membrane. In such embodiments, the protein of SEQ ID NO:250, or a fragment thereof, is administered to an individual in whom it is desired to increase or decrease any of the foregoing activities. The protein of SEQ ID NO:250 or fragment thereof may be administered directly to the individual or, alternatively, a nucleic acid encoding the protein of SEQ ID NO:250 or a fragment thereof may be administered to the individual. Alternatively, an agent which increases the activity of the protein of SEQ ID NO:250 may be administered to the individual. Such agents may be identified by contacting the protein of SEQ ID NO:250 or a cell or preparation containing the protein of SEQ ID NO:250 with a test agent and assaying whether the test agent increases the activity of the protein. For example, the test agent may be a chemical compound or a polypeptide or peptide.

Alternatively, the activity of the protein of SEQ ID NO:250 may be decreased by administering an agent which interferes with such activity to an individual. Agents which interfere with the activity of the protein of SEQ ID NO:250 may be identified by contacting the protein of SEQ ID NO:250 or a cell or preparation containing the protein of SEQ ID NO:250 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify tissues, preferably pancreas and prostate, or to distinguish between two or more possible sources of a tissue sample on the basis of the level of the protein of SEQ ID NO:250 in the sample. For example, the protein of SEQ ID NO:250 or fragments thereof may be used to generate antibodies using any techniques known to those skilled in the art, including those described therein. Such tissue-specific antibodies may then be used to identify tissues of unknown origin, for example, forensic samples,differentiated tumor tissue that has metastasized to foreign bodily sites, or to differentiate different tissue types in a tissue cross-section using immunochemistry. In such methods a tissue sample is contacted with the antibody, which may be detectably labeled, under conditions which facilitate antibody binding. The level of antibody binding to the test sample is measured and compared to the level of binding to control cells from pancreas or prostate or tissues other than pancrease or prostate to determine whether the test sample is from pancreas or prostate. Alternatively, the level of the protein of SEQ ID NO:250 in a test sample may be measured by determining the level of RNA encoding the protein of SEQ ID NO:250 in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from pancreas or prostate or tissues other than pancreas or prostate to determine whether the test sample is from pancreas or prostate.

In another embodiment, antibodies to the protein of the invention or part thereof may be used for detection, enrichment, or purification of membranes or zymogen granules using any techniques known to those skilled in the art. For example, an antibody against the protein of SEQ ID NO:250 or a fragment thereof may be fixed to a solid support, such as a chromatograpy matrix. A prepartation containing membranes or zymogen granules is placed in contact with the antibody under conditions which facilitate binding to the antibody. The support is washed and then the membranes or zymogen granules are released from the support by contacting the support with agents which cause the membranes or zymogen granules to dissociate from the antibody.

In another embodiment of the present invention, the protein of SEQ ID NO:250 or a fragment thereof thereof may be used to diagnose disorders associated with altered intercellular communication or secretion. In such techniques, the level of the protein of SEQ ID NO:250 in a patient is measured using techniques such as those described herein. The level of the protein of SEQ ID NO:250 in the patient is compared to the level in control individuals. An elevated level or decreased level of the protein of SEQ ID NO:250 relative to control individuals suggests that the patient is suffering from a defect in intercellular communication or secretion.

In another embodiment, the protein of SEQ ID NO:250 or a fragment thereof is used to facilitate or decrease exocytosis. For example, the protein of SEQ ID NO:250 or fragment thereof may be used to increase or decrease the release of secretory enzymes within pancreatic acinar cells or prostatic cells. Accordingly, the protein of the invention or part thereof may be used to diagnose, treat and/or prevent disorders associated with abnormal membrane trafficking including but not limited to viral or other infections, traumatic tissue damage, and hereditary diseases such as pancreatitis or prostatitis, invasive carcinomas and lymphomas. In such methods, the protein of SEQ ID NO:250, a fragment of the protein of SEQ ID NO:250, or an agent which increases or decreases the activity of the protein of SEQ ID NO:250 is administered to an individual using techniques such as those described herein.

In another embodiment, the invention relates to methods of using the protein of SEQ ID NO:250 or a fragment thereof in the diagnosis of pancreatitis or prostatitis by detecting an elevation in the level of the protein of SEQ ID NO:250, in a sample of bodily fluid, such as human blood, serum, or urine. The protein may be detected using any method known to those skilled in the art, including those described herein. In some embodiments, the protein of SEQ ID NO:250 or fragment thereof may be detected using the methods described in U.S. Pat. Nos. 5,436,169 or 5,663,315, the disclosures of which are incorporated herein by reference in their entireties.

References:
U.S. Pat. Nos. 5,436,169; 5,663,315
Nucleic Acids Research 18(9):5900, (1990)
Proc. Natl. Acad. Sci. USA 88(7):2898–2902 (1991)
Proc. Natl. Acad. Sci. USA 89:1189–1193 (1992)
Eur. J. Cell Biol. 61:229–238 (1993
Freedman et al., Annals N.Y. Acad. Sci. 713:199–206, 1994.
Scheele et al., Pancreas 9(2):139–149, 1994.

Protein of Seq Id No: 274 (Internal Designation: 145-56-3-0-D5-CS)

The protein of SEQ ID No: 274 encoded by the cDNA of SEQ ID No: 33 is homologous to the human RNA 3'-terminal phosphate cyclase-like protein 1 (Rcl1) (trEMBL accession number CAB89811) which is abundant in the nucleolus.

The RNA 3'-terminal phosphate cyclase, an enzyme originally identified in extracts from human HeLa cells and *Xenopus oocyte* nuclei, catalyzes the ATP-dependent conversion of the 3'-terminal phosphate group into a 2',3'-cyclic phosphodiester at the 3'-end of RNA, resulting in the activation of the 3' end of RNA molecules. Database searches showed that genes encoding proteins similar to human and *E. coli* human RNA 3'-terminal phosphate cyclase are conserved among eukarya, bacteria and archaea, arguing for an essential function of the enzyme in RNA metabolism (Genschik P. et al.—EMBO J—1998, 16, p.2955–2967). Similarly analysis of the human RNA 3'-terminal phosphate cyclases and related proteins from other organisms, indicated that they can be divided into 2 subfamilies referred to as RNA 3'-terminal phosphate cyclases (Rtc) and RNA 3'-terminal phosphate cyclase-like protein (Rcl). These 2 subfamilies share several sequence elements, including a nearly universally conserved amino acid sequence RGxx-PxGGGx@ (where x stands for any, and @ for hydrophobic amino acids), designated originally as the cyclase signature, which corresponds to the Prosite signature, although structurally slightly different these 2 subfamilies of proteins have the same function and are involved in RNA metabolism. The cyclase signature is present in the protein of the invention (positions 157 to 167). In addition, this protein also displays othere characteristic signatures of RNA 3'-terminal phosphate cyclase proteins (pfam signature from positions 1 to 368 and eMotif signatures from positions 12 to 44 and from positions 157 to 168).

3'-terminal phosphate cyclases (Rtc and Rcl) catalyze the conversion of 3'-terminal phosphate to a 2',3'-cyclic phosphodiester in a reaction dependent on ATP, other nucleoside triphosphates being much less active co-factors. With both enzymes, the cyclization of the 3'-phosphate at the 3'-end of RNA occurs by a three-step mechanism as follows: (a) adenylation of the enzyme by ATP; (b) the enzyme acts on RNA-N3' P to produce RNA-N3'PP5'A; (c) a non catalytic nucleophilic attack by the adjacent 2'hydroxyl on the phosphorus in the diester linkage to produce the cyclic end product.

RNA 3'-terminal phosphate cyclase proteins are involved in RNA processing. It has been demonstrated that several eukaryotic and prokaryotic RNA ligases require 2',3'-cylic phosphate RNA ends which suggests that the enzyme is involved in generation or maintenance of cyclic termini in RNA ligation substrates, known to be required by several RNA ligases in both eukaryotes and prokaryotes. These ligases include 2 tRNA-splicing ligases, and the prokaryotic RNA ligase of unknown function that joins RNA ends via a typical 2',5'-phospodiester (Arn E. et al.—RNA structure and Function—Cold spring Harbor Laboratory Press—1998 p.695–726). The involvement of these ligases in nuclear pre-tRNA splicing is well documented (Zillmann et al.—Mol Cell Biol—1991, 11, p5410–5416)(Phizicky E. et al.—J Biol Chem, 1992, 267, p4577–4582) but these enzymes might also function in the ligation of virusoids and viroids (Branch A. et al.—Science—1982, 217, p1147–1149) (Kibertis et al.—EMBO J—1985, 4, p817–827)

Alternatively, the cyclase could be responsible for producing cyclic phosphate 3'-ends identified in the spliceosomal U6 small nuclear RNA and some other small RNAs. Furthermore in yeast Rcl is associated to U3 small nucleolar RNP (U3 snoRNP) a central component of the 18S ribosomal RNA (rRNA) processing machinery in yeast and vertebrates (Billy E. et al.—EMBO J—2000, 19, p2115–2126). However it seems that Rcl are not a structural component of U3 snoRNP and its association with U3 snoRNP occurs, most probably, in large macromolecular complexes representing nascent ribosmes. In yeast, depletion or inactivation of Rcl causes a defect in 18S mRNA synthesis, which leads to a decreased levels of 40S ribosomal sub-units, resulting in an accumulation of free 60S ribosomes and a fall in the amount of polysomes. In Yeast 18S, 5.8S and 25S rRNAs are derived from a long 35S precursor. This 35S pre-rRNA is normally cleaved at the A0 site, yielding 33S pre-rRNA. 33S rRNA is then processed rapidly at sites A1 and A2 to generate 20S pre-rRNA, which is further processed into mature 18S rRNA. Deletion or inactivation of Rcl leads to inhibition of processing at sites A0, A1 and A2 (Billy E. et al.—EMBO J—2000, 19, p2115–2126).

It is believed that the protein of SEQ ID No: 274 or part thereof is involved in RNA processing, probably as a RNA 3'-terminal phosphate cyclase. Preferred polypeptides of the invention are polypeptides comprising amino acids 157 to 167, 1 to 368, 12 to 44 and 157 to 168. Other preferred polypeptides of the invention are fragments of SEQ ID No: 274 having any of the biological activities described herein. Assays of cyclase activity can be carried out using the Norit method as described in the article by Filipowicz (Filipowicz W et al.—Methods Enzymol.—1990, 181, p.499–510), which disclosure is hereby incorporated by reference in its entity, or any other techniques known to those skilled in the art.

Thus, an embodiment of the present invention relates to compositions and methods of using the protein of the invention or part thereof in in vitro RNA manipulation to isolate small nucleolar RNPs especially, but not limited to U3 snoRNP from biological samples, using immunoprecipitation techniques (Billy E. et al.—EMBO J—2000, 19, p2115–2126), which disclosure is hereby incorporated by reference in its entity, or any other techniques known to those skilled in the art.

In another embodiment, the protein of the invention or part thereof is used to develop antagonists of the protein of the invention or part thereof in order to inhibit or decrease cellular proliferation. This can be explained by the fact that protein of the invention or part thereof is probably involved in rRNA maturation, thus the use of products that inhibit rRNA maturation prevents the formation of functional ribosomes, which leads to an inhibition of protein synthesis. Cells that are unable to synthesis proteins stop to grow and ultimately die due to the fact that they are unable to regenerate proteins. One preferred embodiment of the invention pertains to the use of the protein of the invention or part thereof to develop these antagonists, which are added to samples or materials as a "cocktail" in association with other antimicrobial substances to stop and/or prevent proliferation of undesired contaminants. For example the protein of the invention or part thereof may be used to inhibit the proliferation of undesired bacteria and or viruses in in vitro cultures. In another preferred embodiment of the invention the protein or part thereof could be used to develop antagonists that could be administered to patients suffering from viral and or bacterial infection particularly viral infections by viruses such as HIV and HCV. This could for example be accomplished by targeting the antagonists to cells infected by the virus or directly to bacteria. Once inside these cells the antagonist will inhibit or at least decrease protein synthesis resulting in an inhibition or a decrease in bacterial and/or viral replication. In yet another preferred embodiment of the invention the protein or part thereof could be used to develop antagonists that could be administered to patients in order to inhibit abnormal and/or unregulated cellular proliferation found in diseases such as cancers, psoriasis, Systemic lupus erythematosus (SLE), arthritis, endometriosis, enteropathy in immunodeficiency virus infection, venous eczema (inducing connective tissue sclerosis in lipodermatosclerosis and causing the reduced reepithelialization tendency in venous ulcers), chronic irritant contact dermatitis (CICD), adult polycystic kidney disease (APKD), ichthyosis, cholesteatoma.

Protein of SEQ ID NOs:303 (Internal Designation Number 187-31-0–0-F12-CS) and 275 (Internal Designation Number 145-59-2-0-A7-CS)

The 148-amino-acid long protein of SEQ ID NO:303, encoded by the cDNA of SEQ ID NO:62, found in fetal kidney and highly expressed in this organ, is homologous to the human RNA-associated protein HSCP250 (SPTREMBLNEW SPTREMBL SWISSPROT accession number AAF36170 and GENESEQP accession number Y84433). In addition, this protein displays significant homology to the ribosomal L27 protein of D. melanogaster (GENPEPT GENPEPTNEW accession number AE003576) and to the 50S ribosomal L27 protein of E. coli (SWISSPROT accession number P02427). The protein of SEQ ID NO:303 has a putative signal peptide, from amino acid position 13 to 27. According to the PFAM program, the protein of the invention also presents a ribosomal L27 protein signature in position 31 to 81. Amino acid residues in position 64 to 78 are highly similar to the consensus pattern: G-X-[LIVM](2)-X-R-Q-R-G-X(5)-G, where X is any amino acid (the motif found in the protein of SEQ ID NO:303 is G-X-I-I-X-T-Q-R-H-X(5)-G). Potential phosphorylation sites exist in positions 32, 38, 47 (S amino residues), 60 (Y amino residue), 69 and 141 (T amino residues). One of them, the T residue in position 69, is embedded in the ribosomal L27 protein signature described above.

The protein of SEQ ID NO:275, encoded by the cDNA of SEQ ID NO:34, is a 94-amino-acid long variant of the SEQ ID NO:303 protein. While the first 81 amino acid residues of protein of SEQ ID NO:275 are strictly homologous to the first 81 amino acid residues of protein of SEQ ID NO:303, the 13 subsequent amino-acids are different. In addition to the putative signal peptide (position 13 to 27), the ribosomal L27 protein signature (position 64 to 78), and phosphorylation sites (positions 32, 38, 47, 60 and 69), the protein of SEQ ID NO:275 also displays a candidate membrane-spanning segment in position 74 to 94.

Ribosomal protein L27 is one of the proteins of the large ribosomal subunit. L27 belongs to a family of ribosomal proteins which, on the basis of sequence similarities, includes: eubacterial L27, plant chloroplast L27 (nuclear-encoded), algal chloroplast L27 and yeast mitochondrial YmL2 (gene MRPL2 or MRP7). Among the different ribosomal L27 proteins characterized so far, the one of E. coli is probably the best studied. Protein L27 is one of the smallest and the most basic polypeptides in E. coli ribosome. Techniques like the measurement of protein exposure by hot tritium bombardment have shown that L27 of the large subunit is well exposed on the surface of the E. coli 70S ribosome (Agafonov et al., Proc. Natl. Acad. Sci. 94:12892–12897 (1997)). Chemical and UV crosslinking studies have demonstrated that L27 is closely associated with domain V of the 23S rRNA, a region that comprises part of the peptidyl transferase center (Osswald et al., Nucleic Acids Res. 18:6755–6760 (1990)). Direct evidence for the presence of L27 at the peptidyl transferase center was obtained through the use of derivatives of tRNA$^{Phe}$ containing photoreactive azidonucleotides within the 3'-terminal ACCA$_{OH}$ sequence (Wower et al., Proc. Natl. Acad. Sci.

86:5232–5236 (1989)). Analysis of a mutant *E. coli* strain in which the rpmA gene, which encodes L27, was replaced by a Kanamycin marker, has suggested that L27 contributes to peptide bond formation by facilitating the proper placement of the acceptor end of the A-site tRNA at the peptidyl transferase center (Wower et al., J. Biol. Chem. 273:19847–19852 (1998)). Further, recent studies conducted by Thiede and collaborators have precisely determined RNA-protein contact sites in the 50S ribosomal subunit of *E. coli* (Thiede et al., Biochem. J. 334:39–42 (1998)), showing that Lys-71 and Lys-74 of L27 interact with U-2334 of the 23S rRNA.

It is believed that the proteins of SEQ ID NOs: 303 and 275 are human RNA-associated proteins. Preferred polypeptides of SEQ ID NO:303 are polypeptides comprising the amino acids from positions 13 to 27, 64 to 78 and amino acid residues in positions 32, 38, 47, 60, 69 and 141. It is believed that the protein of SEQ ID NO:275 is a 94 amino acid long variant of the 148 amino acid residues protein of SEQ ID NO:303. Preferred polypeptides of SEQ ID NO:275 are polypeptides comprising the amino acids from positions 13 to 27, 64 to 78, 74 to 94 and amino acid residues in positions 32, 38, 47, 60, and 69. Other preferred polypeptides of the invention are fragments of SEQ ID NO:303 or 275 having any of the biological activities described herein.

One embodiment of the present invention involves the use of the present proteins and nucleic acids to specifically identify cells from the kidney, especially from the fetal kidney. Such cells can be detected by virtue of their strong expression of the protein of the invention, and can thus be detected using any standard method for detecting protein expression or activity, including methods involving antibodies, specific nucleic acids, or any other detectable molecule that specifically binds to the polypeptides or polynucleotides of the invention. An ability to specifically detect kidney cells is useful, e.g. for determining the identity of tumor cells as well as for the identification of specific cell types and tissues for, e.g. histological analyses.

In another embodiment of the present invention, the present proteins are used as a component of in vitro eukaryotic translation systems. Such systems represent a widely used tool for protein production with many academic and industrial applications. Similarly, inhibitors of the protein of the invention, e.g. antibodies or dominant negative forms of the protein, can be used to inhibit in vitro translation systems, e.g. to specifically stop a translation reaction involving a eukaryotic cell extract.

In another embodiment, the proteins of SEQ ID NO:303 or 275 can be used to bind to nucleic acids, preferably RNA, alone or in combination with other substances. For example, the proteins of the invention or part thereof can be added to a sample containing RNAs in optimum conditions for binding, and allowed to bind to RNAs. In a preferred such embodiment, the proteins of the invention or part thereof may be used to purify mRNAs, for example to specifically isolate RNA, e.g. from a specific cell type or from cells grown under particular conditions. Such RNAs could then be reverse transcribed and cloned, could be analyzed for relative expression analyses, etc. In addition, such methods may be used to specifically remove RNA from a sample, for example during the purification of DNA. To carry out any of these methods, the proteins of the invention or part thereof may be bound to a chromatographic support, either alone or in combination with other RNA binding proteins, to form an affinity chromatography column. A sample containing a mixture of nucleic acids to purify is then run through the column. Immobilizing the proteins of the invention or part thereof on a support is particularly advantageous for embodiments in which the method is to be practiced on a commercial scale. This immobilization facilitates the removal of RNAs from the batch of resin-coupled protein after binding, and allows subsequent re-use of the protein. Immobilization of the proteins of the invention or part thereof can be accomplished, for example, by inserting any matrix binding domain in the protein according to methods known to those skilled in the art. The resulting fusion product including the proteins of the invention or part thereof is then covalently, or by any other means, bound to a protein, carbohydrate or matrix (such as gold, "Sephadex" particles, polymeric surfaces).

Still another embodiment of the invention relates to methods of preparing antibodies directed against the proteins of the invention or part thereof. Such antibodies may be used, e.g., in co-immunoprecipitation experiments to separate and purify RNAs associated with the proteins of the invention. To accomplish this, in a sample containing a mixture of nucleic acids, antibodies directed against the protein of the invention may be added in association with protein A or protein G sepharose beads. Immunoprecipitation conditions are well known to those skilled in the art.

The invention further relates to methods and compositions used to modify the proteins of the invention. In a preferred embodiment, K amino-acids of the proteins of the invention are substituted for other basic amino-residues (R residues), as some of these K residues seem to be crucial for RNA interactions (Thiede et al., Biochem. J. 334:39–42 (1998)). Conversely, R residues of the proteins of the invention may be substituted for K residues. These substitutions are predicted to change the specificity and/or the affinity of the proteins of the invention for RNA molecules. Another preferred embodiment may be to perform post-translational modifications of the proteins of the invention, notably at the level of the putative phosphorylation sites described above in positions 32, 38, 47, 60, 69 and 141 of SEQ ID NO:303. By adding negative charges to the proteins of the invention, these phosphorylation sites may modulate the affinity of the protein for RNA molecules. Phosphorylation of T residue in position 69 is of great interest, as it is embedded in the ribosomal L27 protein signature.

In another preferred embodiment, the proteins of the invention or part thereof may be used to visualize RNAs, when the polypeptides are linked to an appropriate fusion partner, or is detected by probing with an antibody.

Another embodiment of the present invention relates to methods and compositions using the proteins of the invention, or part thereof, to associate specific mRNAs to the inner face of lipidic bilayers of liposomes in order to further introduce these mRNAs into the cytoplasm of eukaryotic cells. For example, as described above, the protein of the invention of SEQ ID NO:275 displays both a candidate membrane-spanning segment in position 74 to 94 (at its very carboxy-terminal part), and a ribosomal L27 protein signature in position 64 to 78. Moreover SEQ ID NO:275 is an RNA binding protein. Preferably, specific mRNAs are first associated with the protein of the invention and the RNA/protein complex formed in that way is then mixed with liposomes according to methods known to those skilled in the art. These liposomes are added to an in vitro culture of eukaryotic cells. In vivo, such a method might treat and/or prevent disorders linked to dysregulation of gene transcription such as cancer and other disorders relating to abnormal cellular differentiation, proliferation, or degeneration.

In another embodiment, the present proteins and nucleic acids can be used to modulate the rate of cell growth in vitro or in vivo. Studies in *Drosophila* have shown that a decrease in ribosome function results in a significant inhibition of cell growth. Accordingly, compounds that inhibits the expression or function of the proteins of the invention can be used to inhibit the growth rate of cells, and can thus be used, e.g. in the treatment or prevention of diseases or conditions associated with excessive cell growth, such as cancer or inflammatory conditions. Such compounds include, but are not limited to, antibodies, antisense molecules, dominant negative forms of the proteins, and any heterologous compounds that inhibit the expression or the activity of the proteins.

Protein of SEQ ID NO:269 (Internal Designation 116-115-2-0-F8-CS)

The protein of SEQ ID NO:269 encodes Thernase and is encoded by polynucleotide sequence of SEQ ID NO:28. Thernase is homologous to mink whale ribonuclease A (Emmens M., et al., Biochem. J. 157:317–323(1976)), a member of the pancreatic ribonuclease family. Thernase exhibits 2 hydrophobic domains, the first corresponding to signal peptide at amino acid positions 1–21, the second corresponding to transmembrane segment at amino acid positions 179–199. Thernase is highly expressed in the testis.

Ribonucleases are proteins that catalyze the hydrolysis of phosphodiester bonds in RNA chains. In addition to their function in the hydrolysis of RNA, ribonucleases have evolved to support a variety of other physiological activities. Such activities include anti-pathogenic and anti-neoplastic activities. For example, bovine seminal ribonuclease is anti-neoplastic (Laceetti, P. et al. (1992) Cancer Res. 52: 4582–4586 which disclosure is hereby incorporated by reference in its entirety), and some frog ribonucleases display both anti-viral [including anti-human immunodeficiency virus (HIV)] and anti-neoplastic activities (Youle, R. J. et al. (1994) Proc. Natl. Acad. Sci. USA 91: 6012–6016; Mikulski, S. M. et al. (1990) J. Natl. Cancer Inst. 82: 151–152; and Wu, Y.-N. et al. (1993) J. Biol. Chem. 268: 10686–10693 which references are hereby incorporated by reference in their entirety). The ribonuclease eosinophil cationic protein (ECP) exhibits anti-parasitic, anti-bacterial, and anti-neoplastic activities. Finally, ribonuclease RNase k6 is expressed in normal human monocytes and neutrophils, suggesting a role for this ribonuclease in host defense (Rosenberg, H. F. and Dyer, K. D. (1996) Nuc. Acid. Res. 24: 3507–3513 which reference is hereby incorporated by reference in its entirety).

Thernase is a novel human ribonuclease that also plays a role in a number of other processes. In its ribonuclease capacity, Thernase hydrolyzes ribonucleic acid (RNA). Other physiological activities carried out by Thernase include defense against infection and defense against neoplasia. Preferred polypeptide of the invention is that encoding Thernase. Other preferred polypeptides of the invention are any fragments of Thernase having any of the biological activities described herein. Further preferred polypeptide is that encoding the extracellular region of Thernase. The ribonuclease activity of Thernase or any fragment thereof may be assayed using any assay known to those skilled in the art, including those described in U.S. Pat. No. 5,866,119, which disclosure is hereby incorporated by reference in its entirety.

In a preferred embodiment, the present invention provides for a method of using Thernase or any fragment thereof to hydrolyze RNA, alone or in combination with other substances. In further preferred embodiment, Thernase or any fragment thereof is used to remove contaminating RNA in a biological sample, alone or in combination with other ribonucleases. In a more preferred embodiment, Thernase or any fragment thereof is used to remove contaminating RNA from DNA preparations, to remove free RNA probe from hybridization reactions, and to remove RNA prior to analysis of in vitro translation products. In one such embodiment, Thernase or any fragment thereof is added to a biological sample as a "cocktail" along with other ribonucleases.

In further preferred embodiment, the present invention provides for a method wherein Thernase or any fragment thereof is used to decontaminate or disinfect samples infected by undesirable parasite, bacteria and/or virus using any of the methods known to those skilled in the art including those described in Youle, R. J. et al. (1994) Proc. Natl. Acad. Sci. USA 91: 6012–6016; Mikulski, S. M. et al. (1990) J. Natl. Cancer Inst. 82: 151–152; and Wu, Y.-N. et al. (1993) J. Biol. Chem. 268: 10686–10693 which references are hereby incorporated by reference in their entirety. In one such embodiment, Thernase or any fragment thereof is used to eliminate RNA virus from a sample.

In a preferred embodiment, the present invention provides for a method wherein Thernase or any fragment thereof is used in vitro to selectively kill cells. In further preferred embodiment, Thernase or any fragment thereof is linked to a recognition moiety capable of binding to a chosen cell ("Thernase conjugate"), such as lectins, receptors, ligands to receptors, or antibodies, thereby generating cell-specific cytotoxic reagents as described in U.S. Pat. No. 5,955,073, which disclosure is hereby incorporated by reference in its entirety. In one such embodiment, said Thernase conjugate is used for residual tumor cell ablation from bone marrow samples obtained from cancer patients prior to full body radiation and subsequent reinfusion of the treated bone marrow cells as a source of stem cells.

In a preferred embodiment, the present invention provides for a method of using Thernase or any fragment thereof as an anti-viral agent. Preferred delivery is intravenous injection. Further preferred is a method to use Thernase or any fragment thereof to treat a viral infection wherein the virus is selected from, but not restricted to, the group consisting of:

a) Human immunodeficiency virus;
b) Hepatitis C virus;
c) Hepatitis D virus;
d) Hepatitis F virus;
e) Cytomegalovirus;
f) Respiratory syncytial virus;
g) Herpes simplex virus type I;
h) Herpes simplex virus type II;
i) Influenza virus;
j) Parvovirus;
k) Coxsachie virus;
l) Echovirus;
m) Epstein-Barr virus;
n) Dengue virus;
o) Lassa fever virus; and
p) Ebola virus.

In a preferred embodiment, the present invention provides for a method of using Thernase or any fragment thereof as an anti-bacterial agent. Preferred delivery is intravenous injection. Further preferred is a method to use Thernase or any fragment thereof to treat a bacterial infection wherein the bacteria is selected from, but not restricted to, the group consisting of:

a) *Mycobacterium avium* complex;
b) *Pneumocystis carinii;*
c) *Acne vulgaris;*
d) *Legionella pneumophilia;*
e) *Yersinia pestis;*
f) *Ureaplasma urealyticum;*
g) *Chlamydia pneumoniae;*
h) *Helicobacter pylori;*
i) *Treponema pallidum;*
j) *Neisseria gonorrhoeae;*
k) *Salmonella typhimurium;*
l) *Vibrio cholera;*
m) *Clostridium difficile;*
n) *Bacillary dysentary;*
o) Pencillin resistant *Pneumococcus;*
p) *Burkholderia mallei;*
q) *Mycobacterium leprae;*
r) *Mycobacterium haemophilum;*
s) *Mycobacterium kansasii;*
t) *Haemophilus influenzae;* and
u) *Bacillus anthracis.*

Tumors cells are selectively susceptible to the cytotoxic action of ribonuclease (Youle, R. J. et al. (1994) Proc. Natl. Acad. Sci. USA 91: 6012–6016; Mikulski, S. M. et al. (1990) J. Natl. Cancer Inst. 82: 151–152; and Wu, Y.-N. et al. (1993) J. Biol. Chem. 268: 10686–10693 which references are hereby incorporated by reference in their entirety). A tumor-specific ribonuclease conjugate can exhibit even greater and more specific anti-neoplastic activity than unconjugated ribonuclease. Pancreatic ribonuclease conjugated to epidermal growth factor (EGF) exhibited strong and selective anti-neoplastic activity against cells lines which expressed the receptor for EGF (Hiromitsu, J. et al (1996) Cancer Chemotherapy and Pharmacology 4:303–8 which disclosure is incorporated by reference in its entirety). In a further embodiment of the invention, Thernase or any fragment thereof is used as said conjugate alone or in conjunction with other therapeutic agents as an anti-neoplastic agent. Preferred delivery is intravenous injection or intra-tumor injection. Said conjugate is used in said anti-neoplastic therapy wherein the neoplasm is selected from, but not restricted to, the group consisting of:

a) Melanoma;
b) Breast carcinoma;
c) Lung carcinoma;
d) Cervical carcinoma;
e) Renal carcinoma;
f) Colon carcinoma;
g) Prostate carcinoma;
h) Pancreas carcinoma;
i) Colorectal carcinoma;
j) Hepatoma; and
k) Lung non-small-cell carcinoma.

In a preferred embodiment, the present invention provides for a polyclonal antibody that specifically binds Thernase. Further preferred is a method of making said antibody by immunization of a rabbit with Thernase or any fragment thereof. Further preferred is a method of making said antibody by immunization of a rabbit with the extracellular segment of Thernase or any fragment thereof. Methods of generating said antibodies and of establishing their specificity are well known to those skilled in the art. Methods of establishing specificity are well known to those skilled in the art and include but are not limited to immunoprecipitation, Western blot analysis, and protein sequencing of immuno-precipitated material.

In further embodiment, the present invention provides for a method in which said anti-Thernase antibody is used to specifically detect testis tissue and cells derived from the testis, as Thernase is overexpressed in this tissue. In further preferred embodiment, the present invention provides for a method to use said antibody to identify tissues of unknown origin, such as in forensic samples, differentiated tumor tissue that has metastasized to foreign bodily sites, etc., or to differentiate different tissue types in a tissue cross-section using immunochemistry.

Protein of SEQ ID NO: 390 (Internal Designation 116-118-4-0-A8-CS)

The present inventors have provided a new gene and protein described in SEQ ID No 149 and 390 respectively, belonging to the carbonic anhydrase (CA) family, more particularly the alpha-CA family. This novel alpha-CA related gene is located on the human chromosome 17q24 region.

The Carbonic anhydrases (EC 4.2.1.1) (CA) are zinc metalloenzymes which catalyze the reversible hydration of carbon dioxide. Nine different active Alpha-carbonic anhydrases (alpha-CA) that catalyze the hydration reaction have been found, as well as at least two alpha-CA-related enzymes. All known carbonic anhydrases from the animal kingdom are alpha-CAs, as opposed to beta- and gamma-CAs, which are also zinc containing enzymes but are unrelated by sequence. The protein of SEQ ID No. 390 displays significant homology to the pfam Carbonic anhydrase domains amino acids between 20- to 59 of the protein, in particular the motif Gly-Ser-Glu-His in position 45 to 48 of the protein which has been found to be highly conserved in a multi-alignment published by Lovejoy et al. 1998 (Genomics 54, 484–493). The chromosomal localization was found by BLAST alignment with a sequence mapping to chromosome 17 (genbank genomic fragment with accession number AC002090) and another alignment with a genomic fragment (accession number AF064854) which maps the gene in the 17q24 region. The polypeptide of SEQ ID No. 390 displays particularly high homology to a human protein called carbonic anhydrase-related protein 10 (genbank accession number AB036836, published directly in database by Adachi,K. and Nishimori,I).

The human alpha-CAs contain a highly conserved catalytic site which comprises a zinc coordination polyhedron defining an active site located in a large cone-shaped cavity that extends almost to the center of the alpha-CA molecule. One site of the cavity is formed by hydrophobic residues, which the other side contains hydrophillic residues, including Thr199 and Glu106 (referring to CA II enzyme). The zinc ion is located at the bottom of this cleft, and tetrahedrally coordinated to the imidazoles of three histidine residues (His94, His96, His 119, referring to CA II enzyme) and to a water molecule called the 'zinc water' that ionizes to a hydroxide ion with a pK of about 7. (Sly et al., Ann. Rev. Biochem. 64:375–401 (1995). Studies have shown that the Zn—OH—/The199/Glu106 network is important in binding bicarbonate, sulfonamide inhibitors and many anionic inhibitors (Liljas et al., Eur. J. Biochem. 219:1–10).

Improved Alpha-CA Inhibitors

Of the human alpha-CAs, it has been found that the various isozymes have differing tissue distributions and intracellular localizations. Alpha-CA II for example, is expressed in the cytosol of some cell types in virtually every tissue or organ, while alpha-CA I is expressed in colon and erythrocytes, and alpha-CA IV is expressed on the apical surfaces of epithelial cells of some segments of the nephron, the apical plasma membrane in the lower gastrointestinal tract, and the plasma face of endothelial cells of certain capillary beds. The protein of SEQ ID NO: 390 encoded by the cDNA of SEQ ID NO: 149 has been found by the present inventors to be expressed in testes.

The human alpha-CAs have been found to be involved in a range of important biological functions involving pH regulation, $Co_2$ and $HCO_3$-transport, ion transport and water and electrolyte balance. Functions in which alpha-CAs are involved include H+ secretion, $HCO_3$-reabsorption, $HCO_3$-secretion, bone resorption, and production of aqueous humor, cerebrospinal fluid, gastric acid and pancreatic juice. Of particular medical interest, CA II has been found to be implicated in osteoporosis, as CA II defects have been found to be a cause of inherited osteoporosis, found along with renal tubular acidosis and brain calcification.

CA activity can be determined by well known means. Assays used to characterize CA isozyme activity are provided for example in Khalifah, J. Biol. Chem. 246:2561 73 (1971); Chen et al, Biochem 32: 7861–65 (1993); Tu et al., J. Biol. Chem. 258:8867–8871 (1986); and Jewel et al., Biochem. 30:1484–1490 (1991).

Many different inhibitors of CA have been identified, and certain CA inhibitors have been developed as medicaments. CA inhibitors are currently a primary treatment for glaucoma, where inhibition of CA activity reduces intra-ocular pressure by inhibiting formation of aqueous humor. Approved CA inhibitors for glaucoma include Acetazolamide (Diamox®), Methazolamide (Neptazane®), Dorzolamide (Trusopt®) and Brinzolamide (Azopt®).

Improved Broad-Acting CA Inhibitors

In certain treatment settings, there is a need for CA inhibitors capable of inhibiting the broad class of CA isozymes so as to inhibit $CO_2$ hydration activity. Local (topical) use of CA inhibitors has been found advantageous over systemic application for glaucoma, allowing systemic side effects of CA inhibitors to be avoided. However, current CA inhibitors may have limited efficacy in terms of ability to completely inhibit total CA activity. A topical treatment, Dorzolamide (Trosopt®), for example, is an inhibitor of CA II, but only weakly inhibits CA VI. (Hoyng et al,. Drugs, 50(3): 411-434 (2000). Inhibitors of CA II may be unable to inhibit CA I or other CAs, which is thought to result in decreased drug efficacy because other CAs can compensate for loss of CA II activity (Sly and Hu, Ann. Rev. Biochem. 64:375–401 (1995)). In one example, CA I is five to six times as abundant as CA II in human erythrocytes, but has only about 15% of the activity. Thus, CA I contributes about 50% of the total CA activity (Dodgon et al., J. Appl. Physiol. 64:1492–80 (1988). Moreover, CA I may have different inhibitor sensitivity profile from CA II, as CA I is less sensitive to sulfonamide inhibitors, for example. CA II and CA IV on the other hand, show significant resistance to inhibition with halide ions in comparison to CA I. (Sly et al, (1995), supra) Thus, a significant amount of residual CA activity in a cell or tissue of interest may be due to other CAs, including the polypeptide of SEQ ID No. 390.

Thus, in one aspect, alpha-CA related nucleic acid and polypeptide may be useful for the identification of compounds capable of inhibiting the alpha-CA-catalyzed reversible hydration reaction. In one aspect, the method is carried out to identify or select CA inhibitors capable of inhibiting the activity of the polypeptide of SEQ ID No. 390. In other aspects, the method is carried out to identify or select CA inhibitors capable of broadly inhibiting the activity of a large number of CA enzymes. The nucleic acid and polypeptide sequences of the invention can be used in computer based drug design or for carrying out binding predictions with candidate CA inhibitors in view of the extensive structural information publicly available for CA enzymes. In preferred embodiments, the nucleic acid and polypeptide of the invention is used in drug screening assays. Assays may be cell based or non-cell based assays. In one embodiment, a nucleotide or polypeptide sequence of the invention is brought into contact with a candidate CA inhibitor (such as a CA II inhibitor), and binding of the candidate inhibitor to the polypeptide of the invention, or the activity of the polypeptide of the invention is detected. Activity of the polypeptide of the invention may be CA activity, or any other suitable activity possessed by the polypeptide of the invention which may be inhibited by binding of the candidate substance. Assays for detecting hydration of carbon dioxide are well known, and referenced above. In preferred embodiments, a panel of CA isozymes including the polypeptide of the invention are screened against the candidate substance, including one or more enzymes selected from the group consisting of CA I, CA III, CA IV, CA VI, and a CA-RP including but not limited to CA-RP VII, CA-RP X and CA-RP XI. In preferred embodiments, a candidate CA inhibitor is selected according to its ability to broadly inhibit CA isozymes capable of catalyzing the hydration of carbon dioxide. Means to conduct such drug screening assays are well known in the art. In one embodiment drug binding is tested, using means described further herein as well as for example in International Patent Publication No. WO 00/58510, the disclosure of which is incorporated herein by reference in its entirety, particularly the section titled "Methods for screening substances interacting with ... polypeptides". Drug binding assays on a large panel of isozymes may also be carried out in high throughput format using commercially available binding assay systems (Graffinity Pharmaceutical Design GmbH, Heidelberg, Germany).

The method according to the invention may generally be used to identify or select candidate compounds for the treatment of a disorder characterized by a disorder in pH regulation, $CO_2$ and $HCO_3$-transport, ion transport or water and electrolyte balance.

Improved Selective CA Inhibitors

In other therapeutic strategies, CA inhibitors are delivered orally. However, systemic delivery may affect CA enzymes present in other tissues or organs leading to harmful side effects. It can be expected that CA II inhibitors may also partially or fully inhibit other CA isozymes, such as CA I, or a CA-related protein (CA-RP) such as CA-RP VIII, X, XI or CA RPTP-beta (Tashian et al., In "*Carbonic Anhydrase, New Horizons*", W. R. Chegwidden, N. D. Carter and Y. H. Edwards, Eds., Birkhauser, Basel); Adachi,K et al., Genbank accession number AB036836; Lovejoy et al. (1998); Peles et al. (1995)) or the CA polypeptide of SEQ ID No 390. CA-RPTP-beta, for example, has a CA domain having no or reduced CA activity but is thought to be involved in the ligand binding or protein complex participation in view of its binding of contactin by an extracellular region. (Peles et al., Cell 82: 251–260 (1995); Tashian et al., (1998), supra). The inhibition of an isozyme such as CA-RPTP-beta or the isozyme of the present invention by systemic treatment using a non-selective drug may result in harmful side effects.

In one example, while oral CA inhibitors for the treatment of glaucoma (eg. acetazolamide) have been effective and without ocular adverse effects, they have shown important systemic effects, including parasthesia of the acra, fatigue, depression, renal stones and gastrointestinal complaints such as nausea and diarrhoea. (Hoyng et al., 2000, supra) Because CA inhibitors are typically used permanently (eg for glaucoma), or over long periods of time, avoiding side effects is particularly important. Selective CA inhibitors capable of inhibiting a CA isozyme of interest to a greater extent than another CA isozyme may thus offer improved means for the treatment of disease.

In one embodiment, the nucleotide and polypeptide sequences of the present invention may be used to design selective CA inhibitors. Studies have also shown that the different alpha-CA have different inhibitor binding properties (Sly et al., (1995), supra), suggesting that it may be possible to provide compounds that inhibit a CA isozyme of interest, such as CA II, while not binding to or inhibiting related enzymes such as the polypeptide of SEQ ID No. 390. The nucleic acid and polypeptide sequences of the invention can be used in computer based drug design or for carrying out binding predictions with candidate CA inhibitors in view of the extensive structural information publicly available for CA enzymes. In preferred embodiments, the nucleic acid and polypeptide of the invention is used in drug screening assays, including both cell based and non cell based assays. In one embodiment, a nucleotide or polypeptide sequence of the invention is brought into contact with a candidate CA inhibitor (such as a CA II inhibitor), and binding of the candidate inhibitor to the polypeptide of the invention, or the activity of the polypeptide of the invention is detected. Activity of the polypeptide of the invention may be CA activity, or any other suitable activity possessed by the polypeptide of the invention which may be inhibited by binding of the candidate substance. In preferred embodiments, a panel of CA isozymes including the polypeptide of the invention are screened against the candidate substance, including the polypeptide of SEQ ID No 39 and one or more enzymes selected from the group consisting of CA I, CA III, CA IV, CA VI, a CARP including but not limited to CARP VII, CARP X, CARP XI. In preferred embodiments, a candidate CA inhibitor is screened against one or more non-catalytic CA related proteins to eliminate undesired inhibition of these enzymes which may be involved in other important physiological functions. Means to conduct such drug screening assays are well known in the art.

Increasing Alpha-CA Activity for the Treatment of Alpha-CA Deficiency Disease

The polypeptide of the invention may also be used as a source of CA activity, such as for the treatment of disease. The defects in carbonic anhydrases are the cause of several diseases, including osteopetrosis (abnormally dense bone) renal tubular acidosis, cerebral calcification and mental retardation. Also, a carbonic anhydrase-related protein is described as being linked to cone-rod retinal distrophy (Bellinghan et al., 1998, Biochem. Biophys. Res. Comm.: 253, 364–367).

In one aspect, the invention thus involves increasing CA activity by providing increased activity of the polypeptide of SEQ ID No. 390. Increased activity of the polypeptide of SEQ ID No 390 can be provided by any suitable means, as further describer herein. Activity may be provided for example by introducing to a host cell or patient a vector containing a nucleotide sequence of SEQ ID No 149, treating said cell with a compound capable of increasing the expression of the polypeptide of the invention and/or treating a cell or patient directly with a polypeptide of SEQ ID No 390. In preferred embodiments, the polypeptide of the invention comprises at least one amino acid substitution, deletion or insertion. In one aspect, such amino acid changes are preferably in the catalytic site; preferably said amino acid changes involve the substitution, deletion or insertion of a His residue and preferably said amino acid changes increase the $CO_2$ hydration activity of the polypeptide of the invention.

Metal Ion Biosensors

In further aspects, metal ion biosensors can be designed based on the polypeptide of SEQ ID No 390. Determination of metal ion concentrations in complex media such as serum, cell cytoplasm as well as for example seawater are important analytical functions that require high degrees of sensitivity and selectivity.

Biosensors may be particularly useful in detecting metal ion fluxes in and between cells. Such biosensors may exploit metal-binding ability of the polypeptide of the invention, as described by Thompson et al., who have developed such biosensors based on the CA enzyme (CA II). Such biosensors are useful in the detection of metal ion flux for example in the central nervous system. Zinc-containing neurons found throughout the mammalian cerebral cortex, striatum and amygdalar nuclei have been shown to release their zinc in a depolarization- and calcium-dependent fashion in vitro and in vivo. This zinc release has been suggested to act as a trans-synaptic neuromodulator which has in turn been linked to excitotoxic neuronal cell death. CA based biosensors developed by Thomspon et al. showed that zinc is present and can be detected in extracellular medium from neurons. (Thompson et al, J. Neurosci Methods 96:35–45 (2000)).

Biosensors based on CA have been shown to be extremely selective, detecting Cu at subpicomolar levels, which is of sensitivity that might be achieved with mass spectometric techniques. Sensors based on the CA II isozyme have been shown to detect Zn and Cu at picomolar levels, and Cd, Co and Ni at nanomolar levels. (Thompson et al., Anal. Biochem. 267:185–195 (1999)). CA based biosensors have also demonstrated selectivity over potential interferents in biological systems at mM levels in extracellular fluids, such as Mg and Ca. (Thompson et al. (2000), supra).

Biosensors based on the polypeptide of the invention are based on the high selectivity and sensitivity of CA isozymes for zinc. Because the binding of Zn in the active site of the enzyme affects the enzyme's ability to bind a CA inhibitor, it is possible to use a CA inhibitor that exhibits a detectable change upon binding to the polypeptide of the invention to detect the fraction of polypeptide bound to the inhibitor, and therefore bound to Zn. The fraction of polypeptide with bound Zn in turn is determined by the concentrations of free Zn and the polypeptide of the invention, and the dissociation constant for zinc.

In one example, binding of the CA inhibitor to the polypeptide of the invention is detected by using a fluorescent inhibitor, whereby the inhibitor shows a detectable change in fluorescence emission wavelength of polarization upon binding to the polypeptide of the invention. In one example, a fluorescent sulfonamide is used, such as the fluorophore ABD-N (Thompson et al. (2000), supra).

Engineered CA Enzymes

CA isozymes have been shown to have differing levels of catalytic activity and efficiency. In preferred embodiments, particularly for treatments which involve providing the increased activity of the polypeptide of SEQ ID No 390 or for use in metal ion biosensors, the polypeptide of the invention may be modified for increased $CO_2$ hydration and/or zinc binding.

In particular, studies have been carried out characterizing residues important for maximal CA activity, allowing CA isozymes to be designed having desired levels of activity. Important structural elements in CA isozymes for zinc binding, $CO_2$ hydration activity and stability are reviewed in Lindskog, Pharmacol. Ther. 74(1):1–20 (1997) and Sly (1995), supra. In one example, studies of CA III showed that changing the Phe198 residue to a Leu198 residue (as in CAII) resulted in a 25 fold increase in activity. (Chen et al., (1993), supra). Catalysis has also been greatly increased in CA II by replacing the Thr200 residue with His, as is normally found in CA I enzymes. Most dramatically, a CA-related protein (CA-RP) which in its native form was missing important residues at the catalytic site and had no detectable CO2 hydration activity at all was rendered an active CA by only two point mutations. (Sjoblom et al., FEBS Lett. 398: 322–325(1996)).

Thus, in embodiments where the polypeptide of the invention is used to provide a source of $CO_2$ hydration or for its zinc binding properties, it is advantageous to modify the polypeptide of the invention by introducing at least one amino acid substitution, deletion or insertion. In one aspect, such amino acid changes are preferably in the catalytic site; preferably said amino acid changes involve the substitution, deletion or insertion of a His residue and preferably said amino acid changes increase the CO2 hydration activity of the polypeptide of the invention. Optimal amino acid changes can be determined by the skilled artisan, particularly in view of sequence comparisons which can be carried out with the many well-characterized CA isozymes.

Protein of SEQ ID NO:252 (Internal Designation 105-089-3-0-G10-CS)

The protein of SEQ ID NO:252 is encoded by the cDNA of SEQ ID NO:11. Accordingly, it will be appreciated that all characteristics and uses of the polypeptide of SEQ ID NO:252 described throughout the present application also pertain to the polypeptide encoded by the human cDNA of clone 105-089-3-0-G10-CS. In addition, it will be appreciated that all characteristics and uses of the nucleic acid of SEQ ID NO:11 described throughout the present application also pertain to the human cDNA of clone 105-089-3-0-G10-CS. It is over represented in fetal brain.

The protein of SEQ ID NO:252 encoded by the cDNA of SEQ ID NO:11 is distributed primarily in the prostate and salivary gland. The protein of SEQ ID NO:252 is homologous to sequences described in PCT publication WO9827205-A2 (which describes a protein that was isolated from a human adult salivary gland cDNA library), PCT publication WO9839446-A2, PCT publication WO9839446-A2. The disclosures of each of the preceding PCT publications is incorporated herein by reference in their entireties.

The protein of SEQ ID NO:252 is also homologous to a polypeptide described in PCT publication WO9835229-A1, the disclosure of which is incorporated herein by reference in its entirety. WO9835229-A1 describes a peptide of 27 amino acid residues that corresponds to 23/27 of a portion of the protein of SEQ ID NO:252 (amino acid 20–46). This corresponds to 85% identity with conserved changes (3 out of 4) yielding a 96% homology.

The protein described in WO 9835229 was identified in reflex tears that were collected from 12 non-contact lens wearing male and female humans. Reflex tears were stimulated by gently rubbing the nasal mucosa with a cotton wool tipped bud. Two different batches were collected from two different groups and examined by analytical and preparative 2-dimensional electrophoresis. After separation in the second dimension and transfer to PVDF membranes, identified protein spots (by 0.1% (w/v) Coomassie Blue) were loaded into a membrane-compatible Hewlett-Packard cartridge. Sequencing was conducted with a Model G1005A (Hewlett-Packard, California) sequenator. One of the proteins identified migrated at 25 kDa and was revealed to have 5 isoforms of different pI. Two of these were N-terminally sequenced and gave the sequence of the above peptide with a pI of 5.0 and 4.4. The different isoforms indicate that this protein undergoes post-translational modifications, including sialylation or acylation. The presence of these isoforms in different degrees could reflect the disease status of the individual. Accordingly, one embodiment of the present invention relates to the detection or diagnosis of disease by determining the activity or level of the protein of SEQ ID NO:252 or a polynucleotide encoding the protein of SEQ ID NO:252 in an individual. For example, detection of the secreted protein of SEQ ID NO:252 in an individual may be accomplished non-invasively by measuring protein levels in bodily fluids into which the protein is secreted, such as tears and saliva. Such methods may be employed both in humans and in animals. It is probable that after the signal peptide is cleaved, the protein of SEQ ID NO:252 is secreted into bodily fluids including tears and probably saliva.

The protein of SEQ ID NO:252 can also be used for the screening of non-ocular diseases, by analyzing tears for marker proteins, particularly indicative of cancer and genetic disease. In addition, an altered chromatographic profile (e.g. 2D gel) of the isoforms of the protein of SEQ ID NO:252 may also indicate the disease state of an individual. For example, the levels of marker proteins in relation to the protein of SEQ ID NO:252 may be determined to evaluate whether the individual is suffering from a disease. Alternatively, tears may be analyzed for the levels of different isoforms of the protein of SEQ ID NO:252 to determine whether the pattern of such isoforms is indicative of disease.

The protein of SEQ ID NO:252 or fragments thereof may also be used as a lubricant or cleansing agent for the eyes. This protein can be included in contact lenses washing and storage solutions. This protein can also be useful as an ingredient in eye washing solutions (e.g. eye drops) used for everyday redness or healing after surgical/laser intervention. For example, the protein may be used to reduce eye inflammation. Alternatively, anti-bacterial properties may be exploited by including the protein of SEQ ID NO:252 or fragments thereof in solutions, creams or ointments for the eyes, as well as creams or ointments in general for external applications.

Accordingly, the present invention includes the use of the protein of SEQ ID NO:252, fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition in an individual. In such embodiments, the protein of SEQ ID NO:252, or a fragment thereof, is administered to an individual in whom it is desired to increase or decrease any of the activities of the protein of SEQ ID NO:252. The protein of SEQ ID NO:252 or fragment thereof may be administered directly to the individual or, alternatively, a nucleic acid encoding the protein of SEQ ID NO:252 or a fragment thereof may be administered to the individual. Alternatively, an agent which increases the activity of the protein of SEQ ID NO:252 may be administered to the individual. Such agents may be identified by contacting the protein of SEQ ID NO:252 or a cell or preparation containing the protein of SEQ ID NO:252 with a test agent and assaying whether the test agent increases the activity of the protein. For example, the test agent may be a chemical compound or a polypeptide or peptide.

Alternatively, the activity of the protein of SEQ ID NO:252 may be decreased by administering an agent which interferes with such activity to an individual. Agents which interfere with the activity of the protein of SEQ ID NO:252 may be identified by contacting the protein of SEQ ID NO:252 or a cell or preparation containing the protein of SEQ ID NO:252 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify the source of a sample as, for example, saliva or tears, or to distinguish between two or more possible sources of a sample on the basis of the level of the protein of SEQ ID NO:252 in the sample. For example, the protein of SEQ ID NO:252 or fragments thereof may be used to generate antibodies using any techniques known to those skilled in the art, including those described therein. Such antibodies may then be used to identify tissues of unknown origin, for example, forensic samples,differentiated tumor tissue that has metastasized to foreign bodily sites, or to differentiate different tissue types in a tissue cross-section using immunochemistry. In such methods a sample is contacted with the antibody, which may be detectably labeled, under conditions which facilitate antibody binding. The level of antibody binding to the test sample is measured and compared to the level of binding to control cells from saliva or tears or tissues other than saliva or tears to determine whether the test sample is from saliva or tears. Alternatively, the level of the protein of SEQ ID NO:252 in a test sample may be measured by determining the level of RNA encoding the protein of SEQ ID NO:252 in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from saliva or tears or tissues other than saliva or tears to determine whether the test sample is from saliva or tears.

In another embodiment, antibodies to the protein of the invention or part thereof may be used for detection, enrichment, or purification of cells expressing the protein of SEQ ID NO:252, including using methods known to those skilled in the art. For example, an antibody against the protein of SEQ ID NO:252 or a fragment thereof may be fixed to a solid support, such as a chromatograpy matrix. A preparation containing cells expressing the protein of SEQ ID NO:252 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:252 or a fragment thereof thereof may be used to diagnose disorders associated with altered expression of the protein of SEQ ID NO:252. In such techniques, the level of the protein of SEQ ID NO:252 in an ill individual is measured using techniques such as those described herein. The level of the protein of 252 in the ill individual is compared to the level in normal individuals to determine whether the individual has a level of the protein of SEQ ID NO:252 which is indicative of disease.

Protein of SEQ ID NO:308 (Internal Designation 187-41-0-0-i21-CS)

The protein of SEQ ID NO:308 is encoded by the cDNA of SEQ ID NO:67. Accordingly, it will be appreciated that all characteristics and uses of the polypeptide of SEQ ID NO:308 described throughout the present application also pertain to the polypeptide encoded by the human cDNA of clone 187-41-0-0-i21-CS. In addition, it will be appreciated that all characteristics and uses of the nucleic acid of SEQ ID NO:67 described throughout the present application also pertain to the human cDNA of clone 187-41-0-0-i21-CS.

The protein of SEQ ID NO:308 is highly homologous to human secreted protein nf87_1 from PCT publication WO 9935252-A2 (the disclsoure of which is incorporated herein by reference in its entirety), to amino acids 26–129 of the human secreted protein SEQ ID NO: 441 from PCT publication WO 9906548-A2 (the disclosure of which is incorporated herein by reference in its entirety), and to amino acids 26–114 of human secreted protein SEQ ID NO:439 from PCT publication WO 9906548-A2, the disclosure of which is incorporated herein by reference in its entirety. Thus, the protein of the invention appears to be a polymorphic variant of nf87_1. Since most of the proteins with high homology to the sequence of the invention have longer 5'termini, it is conceivable that the protein of the invention is a truncated/spliced variant of these proteins.

The protein of SEQ ID NO:308 was identified among the cDNAs from a library constructed from brain. Tissue distribution analysis through a BLAST analysis of databases shows that mRNA encoding this protein was found primarily in kidney, liver, and cancerous prostate.

The protein of SEQ ID NO:308 has chemical and structural homology to human interferon-inducible (IFI) protein isoforms p27 (63%), HIFI (50% identity), and to interferon-induced protein 6–16 precursor (IFI-6–16, 36%). Furthermore, the protein of the invention has structural homology (40% identity) to the human erythropoietin (EPO) primary response gene, EPRG3pt from PCT publication WO 9906063-A2, the disclosure of which is incorporated herein by reference in its entirety. Thus, the present invention relates to nucleic acid and amino acid sequences of a novel IFI protein and to the use of these sequences in the diagnosis, study, prevention and treatment of disease.

The protein of SEQ ID NO:308 comprises 105 amino acids. From the amino acid alignments and the hydrophobicity plots, it has a predicted signal peptide sequence spanning residues 31–43 and two predicted transmembrane domains spanning residues 17–37, and 48–68. Accordingly, one embodiment of the present invention is a polypeptide comprising the signal peptide and/or one or more of the transmembrane doamins.

Interferons (IFNs) are a part of the group of intercellular messenger proteins known as cytokines. α-IFN is the product of a multigene family of at least 16 members, whereas b-IFN is the product of a single gene. α- and β-IFNs are also known as type I IFNs. Type I IFNs are produced in a variety of cells types. Biosynthesis of type I IFNs is stimulated by viruses and other pathogens, and by various cytokines and growth factors. γ-IFN, also known as type II IFN, is produced in T-cells and natural killer cells. Antigens to which the organism has been sensitized stimulate biosynthesis of type II IFN. Both α- and γ-IFNs are immunomodulators and anti-inflammatory agents, activating macrophages, T-cells and natural killer cells.

IFNs are part of the body's natural defense to viruses and tumors. They exert these defenses by affecting the function of the immune system and by direct action on pathogens and tumor cells. IFNs mediate these multiple effects in part by inducing the synthesis of many cellular proteins. Some interferon-inducible (IFI) genes are induced equally well by α-, β- and γ-IFNs. Other IFI genes are preferentially induced by the type I or by the type II IFNs. The various proteins produced by IFI genes possess antitumor, antiviral and immunomodulatory functions. The expression of tumor antigens in cancer cells is increased by α-IFN, and renders the cancer cells more susceptible to immune rejection. The IFI proteins synthesized in response to viral infections are known to inhibit viral functions such as cell penetration, uncoating, RNA and protein synthesis, assembly and release (Hardman J G et al 25 (1996) The Pharmacological Basis of Therapeutics, McGraw-Hill, New York N.Y. pp 1211–1214, the disclosure of which is incorporated herein by reference in its entirety). Type II IFN stimulates expression of major histocompatibility complex (MHC) proteins and is thus used in immune response enhancement.

The IFI gene known as 6–16 encodes an mRNA, which is highly induced by type I IFNs in a variety of human cells (Kelly J M et al (1986) EMBO J 5:1601–1606, the disclosure of which is incorporated herein by reference in its entirety). After induction, 6–16 mRNA constitutes as much as 0.1% of the total cellular mRNA. The 6–16 mRNA is present at only very low levels in the absence of type I IFN, and is only weakly induced by type II IFN. The 6–16 mRNA encodes a hydrophobic protein of 130 amino acids. The first 20 to 23 amino acids comprise a putative signal peptide. Protein 6–16 has at least two predicted transmembrane regions culminating in a negatively charged C-terminus.

The p27 gene encodes a protein with 41% amino acid sequence identity to the 6–16 protein. The p27 gene is expressed in some breast tumor cell lines and in a gastric cancer cell line. In other breast tumor cell lines, in the HeLa cervical cancer cell line, and in fetal lung fibroblasts, p27 expression occurs only upon α-IFN induction. In one breast tumor cell line, p27 is independently induced by estradiol and by IFN (Rasmussen U B et al (1993) Cancer Res 53:4096–4101, the disclosure of which is incorporated herein by reference in its entirety). Expression of p27 was analyzed in 21 primary invasive breast carcinomas, 1 breast cancer bone metastasis, and 3 breast fibroadenomas. High levels of p27 were found in about one-half of the primary carcinomas and in the bone metastasis, but not in the fibroadenomas. These observations suggest that certain breast tumors may produce high levels of, or have increased sensitivity to, type I IFN as compared to other breast tumors (Rasmussen U B et al, supra). In addition, the p27 gene expressed at significant levels in normal tissues including colon, stomach and lung, but not expressed in placenta, kidney, liver or skin. (Rasmussen U B et al, supra).

The small hydrophobic IFI gene products may contribute to viral resistance. A hepatitis-C virus (HCV)-induced gene, 130–51, was isolated from a cDNA library prepared from chimpanzee liver during the acute phase of the infection. The protein product of this gene has 97% identity to the human 6–16 protein (Kato T et al (1992) Virology 190:856–860, the disclosure of which is incorporated herein by reference in its entirety). The authors of the preceding paper suggest that HCV infection actively induces IFN expression, which in turn induces expression of IFI genes including 130–51. The IFI proteins synthesized in response to viral infections are known to inhibit viral functions such as penetration, uncoating, RNA or protein synthesis, assembly or release. The 130–51 protein may inhibit one or more of these functions in HCV. A particular virus may be inhibited in multiple functions by IFI proteins. In addition, the principle inhibitory effect exerted by IFI proteins differs among the virus families (Hardman J G, supra, p 1211, the disclosure of which is incorporated herein by reference).

The HIFI protein (PCT publication WO 9812223-A2, the disclosure of which is incorporated herein by reference in its entirety) is a human sequence identified among cDNAs from a library constructed from human neonatal kidney. Northern blot analysis using LIFESEQ™ database (Incyte Pharmaceuticas, Palo Alto, Calif.) shows that HIFI mRNA was found only in neonatal kidney. The HIFI protein consists of 104 amino acids and has 55%, 45%, and 46% amino acid sequence identity to p27, 6–16 and 130–51, respectively.

Based on the chemical and structural homology between the protein of SEQ ID NO:308 and the small hydrophobic IFI proteins from human and chimpanzee, it is believed that the protein of SEQ ID NO:308 is synthesized when interferons are produced in infections, inflammation, autoimmune diseases etc. Interferons are produced in response to various cytokines and growth factors, in viral infections, inflammation, autoimmune diseases, and cancers. Accordingly, the protein of SEQ ID NO:308 or fragments thereof may be used in diagnosis and treatment of diseases such as, but not limited to, autoimmune disorders such as rheumatoid arthritis, Graves disease, systemic lupus erythematosus, autoimmune hepatitis, Wegener's granulomatosis, sarcoidosis, polyarthritis, pemphigus, pemphigoid, erythema multiform, Sjogren's syndrome, inflammatory bowel disease, multiple sclerosis, myasthenia gravis keratitis, scleritis, Type I diabetes, insulin-dependent diabetes mellitus, Lupus Nephritis, and allergic encephalomyelitis; proliferative disorders including various forms of cancer such as leukemias, lymphomas (Hodgkins and non-Hodgkins), sarcomas, melanomas, adenomas, carcinomas of solid tissue, hypoxic tumors, squamous cell carcinomas of the mouth, throat, larynx, and lung, genitourinary cancers such as cervical and bladder cancer, hematopoietic cancers, head and neck cancers, and nervous system cancers, benign lesions such as papillomas, atherosclerosis, angiogenesis; viral infections, in particular HCV and HIV infections, as well as other pathogen-induced infections (e.g. leishmania).

The protein of SEQ ID NO:308 or fragments thereof may also be used to treat conditions associated with inflammation or immune impairment (e.g. reumathoid and osteo arthritis and AIDS).

Another embodiment of the present invention relates to the use of the protein of SEQ ID NO:308 or fragments thereof to treat and/or prevent the ill-effect of bacterial infection during pregnancy in mammals, such as spontaneous abortion and maternal death. In a preferred embodiment, the protein of the invention may be used to counteract the effects of the bacterial endotoxin lipopolysaccharide (LPS). The methods for using such compositions is described in Dziegielewska and Andersen, Biol. Neonate, 74:372–5 (1998), the disclosure of which is incorporated herein by reference in its entirety.

Furthermore, the protein of SEQ ID NO:308 or fragments thereof are useful as a reagent for analyzing the control of gene expression by interferons and other cytokines in both normal and diseased cells. The protein of the SEQ ID NO:308 or fragments thereof may be used to identify specific molecules with which it binds such as agonists, antagonists or inhibitors.

Another embodiment of the present invention relates to methods of using the protein of SEQ ID NO:308 or fragments thereof to identify and/or quantify cytokines of the interferon family as well as other cytokines such as IL10 and tumor antigens, which may interact with the protein of the invention.

The protein of SEQ ID NO:308 or fragments thereof may also be included in pharmaceutical preparations for treating cancer or prevention/treatment of other diseases associated with changes in expression of the protein of the invention. In another embodiment of the present invention, the protein of SEQ ID NO 308 or fragments thereof is used to inhibit and/or modulate the effect of cytokines and related molecule such as I1-2, TNF alpha, CTLA4, CD28, and others, by preventing the binding of the endogenous cytokine to their natural receptors, thereby blocking cell proliferation or inhibitory signals generated by the ligand-receptor binding event.

The protein of SEQ ID NO:308 or fragments thereof is useful to correct defects in in vivo models of disease such as autoimmune, inflammation and tumor models, by injecting the protein either intra peritoneally intravenously, subcutaneously or directly in the diseased tissue.

The DNA encoding the protein of SEQ ID NO:308 or fragments thereof is useful in diagnostic assays for conditions/diseases associated with expression of the protein of the invention. The diagnostic assay is useful to distinguish between absence, presence, and excess expression of the protein of the invention and to monitor regulation of levels of the protein of the invention during therapeutic intervention. The DNA may also be incorporated into effective eukaryotic expression vectors and directly targeted to a specific tissue, organ, or cell population for use in gene therapy to treat the above mentioned conditions, including tumors and/or to correct disease- or genetic-induced defects in any of the above mentioned proteins including the protein of the invention. The DNA may also be used to design antisense sequences and ribozymes, which can be administered to modify gene expression in tumor and pathogen-infected cells and to influence expression of cytokines and growth factors. In vivo delivery of genetic constructs into subjects can be developed to the point of targeting specific cell types, such as tumor where expression of the protein of the invention may be affected or is modulating the expression and/or activity of other proteins such as cytokines, growth factors, their receptors and/or tumor antigens. It is also useful to detect unknown upstream sequences (e.g. promoters and regulatory elements) by standard techniques and for research into the control of gene expression by interferons and other cytokines, as well as growth and transcription factors in normal and diseased cells. Hybridization probes are useful to detect DNA encoding the protein of the invention (or closely related molecules) in biological samples, and for mapping the naturally occurring genomic sequence to a particular chromosome/chromosome region. The DNA may be used to generate and/or treat in vivo animal models of disease, including susceptibility or resistance to infection, inflammation, tumors and autoimmune conditions, as well as tumor therapy, based on vaccine, knock-out and transgene technologies.

Antibodies against the protein of SEQ ID NO:308 or fragments thereof are useful for the diagnosis of conditions and diseases associated with its expression and to quantify the protein of the invention (e.g. in assays to monitor patients during therapeutic intervention). Antibodies specific for the protein may include, but are not limited to, polyclonal, monoclonal, chimeric, single chain, Fab fragments produced by a Fab expression library. Neutralizing antibodies are especially preferred for diagnostics and therapeutics. Diagnostic assays for the protein of the invention include methods utilizing the antibody and a label to detect the protein of the invention in human body fluids or extracts of cells or tissues.

The protein of the invention and its catalytic or immunogenic fragments or oligopeptides thereof, can be used for screening therapeutic compounds in any variety of drug screening techniques including high throughput. Methods which may be used to quantitate the expression of the nucleotide or protein of the invention include, but are not limited to, polymerase chain reaction (PCR), RT-PCR, RNAse protection, Northern and western blotting, enzyme-linked immunosorbent assay (ELISA), radioimmunoassay (RIA), fluorescent activated cell sorting (FACS), immunoprecipitation, and chromatography.

Under conditions of significant blood loss, EPO therapy, or both, iron-restricted erythropoiesis is evident. However, intravenous or oral iron therapy has substantial drawbacks. Moreover, traditional biochemical markers of storage iron in patients with anemia of chronic disease are unhelpful in the assessment of iron status (Lawrence T et al (2000) Blood 96:823–833, the disclosure of which is incorporated herein by reference in its entirety). As the protein of SEQ ID NO:308 bears homology to the human erythropoietin (EPO) primary response gene, EPRG3pt, it may be used to promote red blood cell formation or to monitor the value of safer intravenous iron preparations in patients with blood loss anemia, particularly those undergoing EPO therapy.

The hydrophobic IFI protein of SEQ ID NO:308 or fragments thereof may be used to diagnose conditions associated with its induction. For example, the protein of SEQ ID NO:308 or fragments thereof may be useful in the diagnosis and treatment of tumors, viral infections, inflammation, or conditions associated with impaired immunity, anemia of chronic blood loss or chronic disease, hemochromatosis, and EPO therapy. Furthermore, this protein may be used for investigating the control of gene expression by IFNs and other cytokines, as well as hormones and growth factors, in normal and diseased cells.

The protein of SEQ ID NO:308 or fragments thereof is useful to correct defects in in vivo models of disease such as autoimmune, inflammation, anemia, iron-overload and tumor models, by injecting the protein either intra peritoneally intravenously, subcutaneously or directly in the diseased tissue.

In addition, the protein of SEQ ID NO:308 is structurally related to other proteins having homology and/or structural similarity with human p27 (Rasmussen, U. B., et al., 1993, Cancer Research 53:4096–4101, the disclosure of which is incorporated herein by reference). Accordingly, the protein of brain, fetal brain, kidney, fetal kidney, or colon may be used to regulate the proliferation of EPO-dependent cells or the growth and development of erythroid and other hematopoietic lineages.

The protein of SEQ ID NO:308 or fragments thereof, or polynucleotides encoding the protein of SEQ ID NO:308 or fragments thereof, may be used to treat or ameliorate anemia of chronic disease and chronic renal failure, polycythemia, cancer, AIDS, drug- and phlebotomy-induced anemias, hemochromatosis, erythropoiesis mediated by EPO therapy, and other conditions associated with altered activity or levels of the protein of SEQ ID NO:308.

In another embodiment, the present invention relates to methods for identifying agonists and antagonists/inhibitors using the protein of SEQ ID NO:308 or fragments thereof, and treating conditions with the identified compounds. In a still further aspect, the invention relates to diagnostic assays for detecting diseases associated with inappropriate levels or activity of the protein of SEQ ID NO:308. In still another embodiment of the invention relates to the use of the protein SEQ ID NO:308, fragments therof or the DNA encoding the protein of SEQ ID NO:308 or fragments thereof to monitor the value of iron therapy in patients undergoing EPO therapy, or experiencing blood loss, or both.

The DNA encoding the protein of SEQ ID NO:308 or fragments thereof is useful in diagnostic assays for conditions/diseases associated with abnormal expression of the protein of SEQ ID NO:308. The diagnostic assay is useful to distinguish between absence, presence, and excess expression of the protein of the invention and to monitor regulation of levels of the protein of the invention during therapeutic intervention. The DNA may also be incorporated into effective eukaryotic expression vectors and directly targeted to a specific tissue, organ, or cell population for use in gene therapy to treat the above mentioned conditions, including tumors and/or to correct disease- or genetic-induced defects in any of the above mentioned proteins including the protein of the invention. The DNA may also be used to design antisense sequences and ribozymes, which can be administered to modify gene expression in tumor and pathogen-infected cells and to influence expression of cytokines, hormones and growth factors. In vivo delivery of genetic constructs into subjects can be developed to the point of targeting specific cell types, such as tumor where expression of the protein of the invention may be affected or is modulating the expression and/or activity of other proteins such as cytokines, growth factors, their receptors and/or tumor antigens. It is also useful to detect unknown upstream sequences (e.g. promoters and regulatory elements) by standard techniques and for research into the control of gene expression by interferons and other cytokines, as well as growth and transcription factors in normal and diseased cells. Hybridization probes are useful to detect DNA encoding the protein of the invention (or closely related molecules) in biological samples, and for mapping the naturally occurring genomic sequence to a particular chromosome/chromosome region. The DNA may be used to generate and/or treat in vivo animal models of disease, including susceptibility or resistance to infection, tumors, autoimmune conditions, anemia and iron-overload, as well as tumor therapy, based on vaccine, knock-out and transgene technologies.

Antibodies against the protein of SEQ ID NO:308 are useful for the diagnosis of conditions and disease associated with its expression and to quantify the protein of the invention (e.g. in assays to monitor patients during therapeutic intervention). Antibodies specific for the protein may include, but are not limited to, polyclonal, monoclonal, chimeric, single chain, Fab fragments produced by a Fab expression library. Neutralizing antibodies are especially preferred for diagnostics and therapeutics. Diagnostic assays for the protein of SEQ ID NO:308 include methods utilizing the antibody and a label to detect the protein of the invention in human body fluids or extracts of cells or tissues.

The protein of SEQ ID NO:308 and its catalytic or immunogenic fragments or oligopeptides thereof, can be used for screening therapeutic compounds in any variety of drug screening techniques including high throughput. Methods which may be used to quantitate the expression of the nucleotide or protein of the invention include, but are not limited to, polymerase chain reaction (PCR), RT-PCR, RNAse protection, Northern blotting, enzyme-linked immunosorbent asay (ELISA), radioimmunoassay (RIA), fluorescent activated cell sorting (FACS), immunoprecipitation, and chromatography.

Accordingly, the present invention includes the use of the protein of SEQ ID NO:308, fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition in an individual. For example, the condition may be cancer, including breast cancer, viral infection, bacterial infection, inflammation, autoimmune disorders, rheumatoid arthritis, Graves disease, systemic lupus erythematosus, autoimmune hepatitis, Wegener's granulomatosis, sarcoidosis, polyarthritis, pemphigus, pemphigoid, erythema multiform, Sjogren's syndrome, inflammatory bowel disease, multiple sclerosis, myasthenia gravis keratitis, scleritis, Type I diabetes, insulin-dependent diabetes mellitus, Lupus Nephritis, and allergic encephalomyelitis; proliferative disorders including various forms of cancer such as leukemias, lymphomas (Hodgkins and non-Hodgkins), sarcomas, melanomas, adenomas, carcinomas of solid tissue, hypoxic tumors, squamous cell carcinomas of the mouth, throat, larynx, and lung, genitourinary cancers such as cervical and bladder cancer, hematopoietic cancers, head and neck cancers, and nervous system cancers, benign lesions such as papillomas, atherosclerosis, angiogenesis; viral infections, in particular HCV and HIV infections, as well as other pathogen-induced infections (e.g. leishmania).

In such embodiments, the protein of SEQ ID NO:308, or a fragment thereof, is administered to an individual in whom it is desired to increase or decrease any of the activities of the protein of SEQ ID NO:308. The protein of SEQ ID NO:308 or fragment thereof may be administered directly to the individual or, alternatively, a nucleic acid encoding the protein of SEQ ID NO:308 or a fragment thereof may be administered to the individual. Alternatively, an agent which increases the activity of the protein of SEQ ID NO:308 may be administered to the individual. Such agents may be identified by contacting the protein of SEQ ID NO:308 or a cell or preparation containing the protein of SEQ ID NO:308 with a test agent and assaying whether the test agent increases the activity of the protein. For example, the test agent may be a chemical compound or a polypeptide or peptide.

Alternatively, the activity of the protein of SEQ ID NO:308 may be decreased by administering an agent which interferes with such activity to an individual. Agents which interfere with the activity of the protein of SEQ ID NO:308 may be identified by contacting the protein of SEQ ID NO:308 or a cell or preparation containing the protein of SEQ ID NO:308 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify the source of a sample as, for example, brain, kidney, liver, or cancerous prostate, or to distinguish between two or more possible sources of a sample on the basis of the level of the protein of SEQ ID NO:308 in the sample. For example, the protein of SEQ ID NO:308 or fragments thereof may be used to generate antibodies using any techniques known to those skilled in the art, including those described therein. Such antibodies may then be used to identify tissues of unknown origin, for example, forensic samples, differentiated tumor tissue that has metastasized to foreign bodily sites, or to differentiate different tissue types in a tissue cross-section using immunochemistry. In such methods a sample is contacted with the antibody, which may be detectably labeled, under conditions which facilitate antibody binding. The level of antibody binding to the test sample is measured and compared to the level of binding to control cells from brain, kidney, liver, or cancerous prostate or tissues other than brain, kidney, liver, or cancerous prostate to determine whether the test sample is from brain, kidney, liver, or cancerous prostate. Alternatively, the level of the protein of SEQ ID NO:308 in a test sample may be measured by determining the level of RNA encoding the protein of SEQ ID NO:308 in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from brain, kidney, liver, or cancerous prostate or tissues other than brain, kidney, liver, or cancerous prostate to determine whether the test sample is from brain, kidney, liver, or cancerous prostate.

In another embodiment, antibodies to the protein of the invention or part thereof may be used for detection, enrichment, or purification of cells expressing the protein of SEQ ID NO:308, including using methods known to those skilled in the art. For example, an antibody against the protein of SEQ ID NO:308 or a fragment thereof may be fixed to a solid support, such as a chromatograpy matrix. A preparation containing cells expressing the protein of SEQ ID NO:308 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:308 or a fragment thereof thereof may be used to diagnose disorders associated with altered expression of the protein of SEQ ID NO:308. In such techniques, the level of the protein of SEQ ID NO:308 in an ill individual is measured using techniques such as those described herein. The level of the protein of SEQ ID NO:308 in the ill individual is compared to the level in normal individuals to determine whether the individual has a level of the protein of SEQ ID NO:308 which is associated with disease.

Protein of SEQ ID NOs:289 and 307 (Internal Designations 175-1-3-0-E5-CS.cor and 187-39-0-0-k12-CS)

The protein of SEQ ID NO:289 is encoded by the cDNA of SEQ ID NO:48. Accordingly, it will be appreciated that all characteristics and uses of the polypeptide of SEQ ID NO:289 described throughout the present application also pertain to the polypeptide encoded by the human cDNA of clone 175-1-3-0-E5-CS. In addition, it will be appreciated that all characteristics and uses of the nucleic acid of SEQ ID NO:48 described throughout the present application also pertain to the human cDNA of clone 175-1-3-0-E5-CS.

The protein of the invention consists of 130 amino acids. From the amino acid alignments and the hydrophobicity plots, it has a predicted signal peptide sequence spanning residues 8–20 and four predicted transmembrane domains spanning residues 2–24, 42–61, 70–90 and 99–119. Accordingly, some embodiments of the present invention relate to polypeptides comprising the signal peptide and/or one or more of the transmembrane domains.

The protein of SEQ ID NO:289 encoded by the cDNA of SEQ ID NO:48 is homologous to SEQ ID NO:4199 from EP 1033401-A2 (the disclosure of which is incorporated herein by reference in its entirety), a human secreted protein. Another protein, SEQ ID NO: 307, encoded by the cDNA of SEQ ID NO:66, is a polymorphic variant of the protein of SEQ ID NO:289, and shares all of the herein-described functions and uses.

The present invention relates to a novel protein identified among the cDNAs from a library constructed from salivary gland, and to the use of the nucleic acid and amino acid sequences disclosed herein in the study, diagnosis, prevention, and treatment of disease. Tissue distribution analysis predicted by BLAST on databases shows that mRNA encoding this protein was found primarily in brain and fetal brain, with lower amounts in kidney, fetal kidney and colon.

Interferons (IFNs) are a part of the group of intercellular messenger proteins known as cytokines. α-IFN is the product of a multigene family of at least 16 members, whereas b-IFN is the product of a single gene. α- and β-IFNs are also known as type I IFNs. Type I IFNs are produced in a variety of cells types. Biosynthesis of type I IFNs is stimulated by viruses and other pathogens, and by various cytokines and growth factors. γ-IFN, also known as type II IFN, is produced in T-cells and natural killer cells. Antigens to which the organism has been sensitized stimulate biosynthesis of type II IFN. Both α- and γ-IFNs are immunomodulators and anti-inflammatory agents, activating macrophages, T-cells and natural killer cells.

IFNs are part of the body's natural defense to viruses and tumors. They exert these defenses by affecting the function of the immune system and by direct action on pathogens and tumor cells. IFNs mediate these multiple effects in part by inducing the synthesis of many cellular proteins. Some interferon-inducible (IFI) genes are induced equally well by α-, β- and γ-IFNs. Other IFI genes are preferentially induced by the type I or by the type II IFNs. The various proteins produced by IFI genes possess antitumor, antiviral and immunomodulatory functions. The expression of tumor antigens in cancer cells is increased by α-IFN, and renders the cancer cells more susceptible to immune rejection. The IFI proteins synthesized in response to viral infections are known to inhibit viral functions such as cell penetration, uncoating, RNA and protein synthesis, assembly and release (Hardman J G et al 25 (1996) The Pharmacological Basis of Therapeutics, McGraw-Hill, New York N.Y. pp 1211–1214, the disclosure of which is incorporated herein by reference in its entirety). Type II IFN stimulates expression of major histocompatibility complex (MHC) proteins and is thus used in immune response enhancement.

The protein of SEQ ID NO:289 is a small hydrophobic protein having chemical and structural homology to human interferon-inducible (IFI) protein isoforms 6–16 (97% identity), HIFI (44%), and p27 (33%), as well as 130–51, the chimpanzee homolog of 6–16—(97%). Thus, the protein of SEQ ID NO:289 and the nucleic acid encoding it are polymorphic variants of 6–16 or the gene encoding 6–16. The protein of SEQ ID NO:289, fragments thereof, or nucleic acids encoding the protein of SEQ ID NO:289 or fragments thereof may be used in the diagnosis, study, prevention and treatment of disease as described below.

The IFI gene known as 6–16 encodes an mRNA, which is highly induced by type I IFNs in a variety of human cells (Kelly J M et al (1986) EMBO J 5:1601–1606, the disclosure of which is incorporated herein by reference in its entirety). After induction, 6–16 mRNA constitutes as much as 0.1% of the total cellular mRNA. The 6–16 mRNA is present at only very low levels in the absence of type I IFN, and is only weakly induced by type II IFN. The 6–16 mRNA encodes a hydrophobic protein of 130 amino acids. The first 20 to 23 amino acids comprise a putative signal peptide. Protein 6–16 has at least two predicted transmembrane regions culminating in a negatively charged C-terminus.

The p27 gene encodes a protein with 41% amino acid sequence identity to the 6–16 protein. The p27 gene is expressed in some breast tumor cell lines and in a gastric cancer cell line. In other breast tumor cell lines, in the HeLa cervical cancer cell line, and in fetal lung fibroblasts, p27 expression occurs only upon α-IFN induction. In one breast tumor cell line, p27 is independently induced by estradiol and by IFN (Rasmussen U B et al (1993) Cancer Res 53:4096–4101, the disclosure of which is incorporated herein by reference in its entirety). Expression of p27 was analyzed in 21 primary invasive breast carcinomas, 1 breast cancer bone metastasis, and 3 breast fibroadenomas. High levels of p27 were found in about one-half of the primary carcinomas and in the bone metastasis, but not in the fibroadenomas. These observations suggest that certain breast tumors may produce high levels of, or have increased sensitivity to, type I IFN as compared to other breast tumors (Rasmussen U B et al, supra). In addition, the p27 gene expressed at significant levels in normal tissues including colon, stomach and lung, but not expressed in placenta, kidney, liver or skin. (Rasmussen U B et al, supra).

The small hydrophobic IFI gene products may contribute to viral resistance. A hepatitis-C virus (HCV)-induced gene, 130–51, was isolated from a cDNA library prepared from chimpanzee liver during the acute phase of the infection. The protein product of this gene has 97% identity to the human 6–16 protein (Kato T et al (1992) Virology 190:856–860, the disclosure of which is incorporated herein by reference in its entirety). The authors of this paper suggest that HCV infection actively induces IFN expression, which in turn induces expression of IFI genes including 130–51. The IFI proteins synthesized in response to viral infections are known to inhibit viral functions such as penetration, uncoating, RNA or protein synthesis, assembly or release. The 130–51 protein may inhibit one or more of these functions in HCV. A particular virus may be inhibited in multiple functions by IFI proteins. In addition, the principle inhibitory effect exerted by IFI proteins differs among the virus families (Hardman J G, supra, p 1211, the disclosure of which is incorporated herein by reference).

The HIFI protein (PCT publication WO 9812223-A2, the disclosure of which is incorporated herein by reference in its entirety) is a human sequence identified among cDNAs from a library constructed from human neonatal kidney. Northern blot analysis using LIFESEQ™ database (Incyte Pharmaceuticas, Palo Alto, Calif.) shows that HIFI mRNA was found only in neonatal kidney. The HIFI protein consists of 104 amino acids and has 55%, 45%, and 46% amino acid sequence identity to p27, 6–16 and 130–51, respectively.

The hydrophobic IFI proteins of the invention may provide the basis for clinical diagnosis of diseases associated with their induction. These proteins may be useful in the diagnosis and treatment of tumors, viral infections, inflammation, or conditions associated with impaired immunity. Furthermore, these proteins may be used for investigations of the control of gene expression by IFNs and other cytokines in normal and diseased cells.

Based on the chemical and structural homology among the protein of SEQ ID NO:289 and the small hydrophobic IFI proteins from human and chimpanzee, it is believed that the protein of SEQ ID NO:289 is synthesized when interferons are produced in infections, inflammation, autoimmune diseases etc. Interferons are produced in response to various cytokines and growth factors, in viral infections, inflammation, autoimmune diseases, and cancers. Accordingly, the protein of SEQ ID NO:289 or fragments thereof may be used in diagnosis and treatment of diseases such as, but not limited to, autoimmune disorders such as rheumatoid arthritis, Graves disease, systemic lupus erythematosus, autoimmune hepatitis, Wegener's granulomatosis, sarcoidosis, polyarthritis, pemphigus, pemphigoid, erythema multiform, Sjogren's syndrome, inflammatory bowel disease, multiple sclerosis, myasthenia gravis keratitis, scleritis, Type I diabetes, insulin-dependent diabetes mellitus, Lupus Nephritis, and allergic encephalomyelitis; proliferative disorders including various forms of cancer such as leukemias, lymphomas (Hodgkins and non-Hodgkins), sarcomas, melanomas, adenomas, carcinomas of solid tissue, hypoxic tumors, squamous cell carcinomas of the mouth, throat, larynx, and lung, genitourinary cancers such as cervical and bladder cancer, hematopoietic cancers, head and neck cancers, and nervous system cancers, benign lesions such as papillomas, atherosclerosis, angiogenesis; viral infections, in particular HCV and HIV infections, as well as other pathogen-induced infections (e.g. leishmania).

The protein of SEQ ID NO:289 or fragments thereof may also be used to treat conditions associated with inflammation or immune impairment (e.g. reumathoid and osteo arthritis and AIDS).

Another embodiment of the present invention relates to the use of the protein of SEQ ID NO:289 or fragments thereof to treat and/or prevent the ill-effect of bacterial infection during pregnancy in mammals, such as spontaneous abortion and maternal death. In a preferred embodiment, the protein of the invention may be used to counteract the effects of the bacterial endotoxin lipopolysaccharide (LPS). The methods for using such compositions is described in Dziegielewska and Andersen, Biol. Neonate, 74:372–5 (1998), the disclosure of which is incorporated herein by reference in its entirety.

Furthermore, the protein of SEQ ID NO:289 or fragments thereof are useful as a reagent for analyzing the control of gene expression by interferons and other cytokines in both normal and diseased cells. The protein of the SEQ ID NO:289 or fragments thereof may be used to identify specific molecules with which it binds such as agonists, antagonists or inhibitors.

Another embodiment of the present invention relates to methods of using the protein of SEQ ID NO:289 or fragments thereof to identify and/or quantify cytokines of the interferon family as well as other cytokines such as IL-10 and tumor antigens, which may interact with the protein of the invention.

The protein of SEQ ID NO:289 or fragments thereof may also be included in pharmaceutical preparations for treating cancer or prevention/treatment of other diseases associated with changes in expression of the protein of the invention. In another embodiment of the present invention, the protein of SEQ ID NO:289 or fragments thereof is used to inhibit and/or modulate the effect of cytokines and related molecule such as IL-2, TNF alpha, CTLA4, CD28, and others, by preventing the binding of the endogenous cytokine to their natural receptors, thereby blocking cell proliferation or inhibitory signals generated by the ligand-receptor binding event.

The protein of SEQ ID NO:289 or fragments thereof is useful to correct defects in in vivo models of disease such as autoimmune, inflammation and tumor models, by injecting the protein either intra peritoneally intravenously, subcutaneously or directly into the diseased tissue.

The DNA encoding the protein of SEQ ID NO:289 or fragments thereof is useful in diagnostic assays for conditions/diseases associated with expression of the protein of the invention. The diagnostic assay is useful to distinguish between absence, presence, and excess expression of the protein of the invention and to monitor regulation of levels of the protein of the invention during therapeutic intervention. The DNA may also be incorporated into effective eukaryotic expression vectors and directly targeted to a specific tissue, organ, or cell population for use in gene therapy to treat the above mentioned conditions, including tumors and/or to correct disease- or genetic-induced defects in any of the above mentioned proteins including the protein of the invention. The DNA may also be used to design antisense sequences and ribozymes, which can be administered to modify gene expression in tumor and pathogen-infected cells and to influence expression of cytokines and growth factors. In vivo delivery of genetic constructs into subjects can be developed to the point of targeting specific cell types, such as tumor where expression of the protein of the invention may be affected or is modulating the expression and/or activity of other proteins such as cytokines, growth factors, their receptors and/or tumor antigens. It is also useful to detect unknown upstream sequences (e.g. promoters and regulatory elements) by standard techniques and for research into the control of gene expression by interferons and other cytokines, as well as growth and transcription factors in normal and diseased cells. Hybridization probes are useful to detect DNA encoding the protein of the invention (or closely related molecules) in biological samples, and for mapping the naturally occurring genomic sequence to a particular chromosome/chromosome region. The DNA may be used to generate and/or treat in vivo animal models of disease, including susceptibility or resistance to infection, inflammation, tumors and autoimmune conditions, as well as tumor therapy, based on vaccine, knock-out and transgene technologies.

Antibodies against the protein of SEQ ID NO:289 or fragments thereof are useful for the diagnosis of conditions and diseases associated with its expression and to quantify the protein of the invention (e.g. in assays to monitor patients during therapeutic intervention). Antibodies specific for the protein may include, but are not limited to, polyclonal, monoclonal, chimeric, single chain, Fab fragments produced by a Fab expression library. Neutralizing antibodies are especially preferred for diagnostics and therapeutics. Diagnostic assays for the protein of the invention include methods utilizing the antibody and a label to detect the protein of the invention in human body fluids or extracts of cells or tissues.

The protein of the invention and its catalytic or immunogenic fragments or oligopeptides thereof, can be used for screening therapeutic compounds in any variety of drug screening techniques including high throughput. Methods which may be used to quantitate the expression of the nucleotide or protein of the invention include, but are not limited to, polymerase chain reaction (PCR), RT-PCR, RNAse protection, Northern and western blotting, enzyme-linked immunosorbent asay (ELISA), radioimmunoassay (RIA), fluorescent activated cell sorting (FACS), immunoprecipitation, and chromatography.

Accordingly, the present invention includes the use of the protein of SEQ ID NO:289, fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition in an individual. For example, the condition may be cancer, including breast cancer, viral infection, bacterial infection, inflammation, autoimmune disorders, rheumatoid arthritis, Graves disease, systemic lupus erythematosus, autoimmune hepatitis, Wegener's granulomatosis, sarcoidosis, polyarthritis, pemphigus, pemphigoid, erythema multiform, Sjogren's syndrome, inflammatory bowel disease, multiple sclerosis, myasthenia gravis keratitis, scleritis, Type I diabetes, insulin-dependent diabetes mellitus, Lupus Nephritis, and allergic encephalomyelitis; proliferative disorders including various forms of cancer such as leukemias, lymphomas (Hodgkins and non-Hodgkins), sarcomas, melanomas, adenomas, carcinomas of solid tissue, hypoxic tumors, squamous cell carcinomas of the mouth, throat, larynx, and lung, genitourinary cancers such as cervical and bladder cancer, hematopoietic cancers, head and neck cancers, and nervous system cancers, benign lesions such as papillomas, atherosclerosis, angiogenesis; viral infections, in particular HCV and HIV infections, as well as other pathogen-induced infections (e.g. leishmania).

In such embodiments, the protein of SEQ ID NO:289, or a fragment thereof, is administered to an individual in whom it is desired to increase or decrease any of the activities of the protein of SEQ ID NO:289. The protein of SEQ ID NO:289 or fragment thereof may be administered directly to the individual or, alternatively, a nucleic acid encoding the protein of SEQ ID NO:289 or a fragment thereof may be administered to the individual. Alternatively, an agent which increases the activity of the protein of SEQ ID NO:289 may be administered to the individual. Such agents may be identified by contacting the protein of SEQ ID NO:289 or a cell or preparation containing the protein of SEQ ID NO:289 with a test agent and assaying whether the test agent increases the activity of the protein. For example, the test agent may be a chemical compound or a polypeptide or peptide.

Alternatively, the activity of the protein of SEQ ID NO:289 may be decreased by administering an agent which interferes with such activity to an individual. Agents which interfere with the activity of the protein of SEQ ID NO:289 may be identified by contacting the protein of SEQ ID NO:289 or a cell or preparation containing the protein of SEQ ID NO:289 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify the source of a sample as, for example, brain, fetal brain, kidney, fetal kidney, or colon, or to distinguish between two or more possible sources of a sample on the basis of the level of the protein of SEQ ID NO:289 in the sample. For example, the protein of SEQ ID NO:289 or fragments thereof may be used to generate antibodies using any techniques known to those skilled in the art, including those described therein. Such antibodies may then be used to identify tissues of unknown origin, for example, forensic samples, differentiated tumor tissue that has metastasized to foreign bodily sites, or to differentiate different tissue types in a tissue cross-section using immunochemistry. In such methods a sample is contacted with the antibody, which may be detectably labeled, under conditions which facilitate antibody binding. The level of antibody binding to the test sample is measured and compared to the level of binding to control cells from brain, fetal brain, kidney, fetal kidney, or colon or tissues other than brain, fetal brain, kidney, fetal kidney, or colon to determine whether the test sample is from brain, fetal brain, kidney, fetal kidney, or colon. Alternatively, the level of the protein of SEQ ID NO:289 in a test sample may be measured by determining the level of RNA encoding the protein of SEQ ID NO:289 in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from brain, fetal brain, kidney, fetal kidney, or colon or tissues other than brain, fetal brain, kidney, fetal kidney, or colon to determine whether the test sample is from brain, fetal brain, kidney, fetal kidney, or colon.

In another embodiment, antibodies to the protein of the invention or part thereof may be used for detection, enrichment, or purification of cells expressing the protein of SEQ ID NO:289, including using methods known to those skilled in the art. For example, an antibody against the protein of SEQ ID NO:289 or a fragment thereof may be fixed to a solid support, such as a chromatograpy matrix. A prepartation containing cells expressing the protein of SEQ ID NO:289 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:289 or a fragment thereof thereof may be used to diagnose disorders associated with altered expression of the protein of SEQ ID NO:289. In such techniques, the level of the protein of SEQ ID NO:289 in an ill individual is measured using techniques such as those described herein. The level of the protein of SEQ ID NO:289 in the ill individual is compared to the level in normal individuals to determine whether the individual has a level of the protein of SEQ ID NO:289 which is associated with disease.

Protein of SEQ ID NO:268 (Internal Designation 116-111-4-0-B3-CS)

The protein of SEQ ID NO:268 is encoded by the cDNA of SEQ ID NO:27. Accordingly, it will be appreciated that all characteristics and uses of the polypeptide of SEQ ID NO:268 described throughout the present application also pertain to the polypeptide encoded by the human cDNA of clone 116-111-4-0-B3-CS. In addition, it will be appreciated that all characteristics and uses of the nucleic acid of SEQ ID NO:27 described throughout the present application also pertain to the human cDNA of clone 116-111-4-0-B3-CS. The protein of the invention is found to be expressed in testis and lungs.

The protein of SEQ ID NO:268 encoded by the extended cDNA SEQ ID NO: 27 is a splicing variant of XAGE-1, a member of the CT antigen family overexpressed in Ewing sarcoma (Liu, X. F., L. J. Helman, et al. (2000). Cancer Res 60(17): 4752–5, the disclosures of which are incorporated by reference herein in their entireties). In addition, the protein of SEQ ID NO:268 also shows strong homology at the COOH end with PAGE4, another member of the CT antigen family (Brinkmann, U., G. Vasmatzis, et al. (1999) Cancer Res 59(7): 1445–8, the disclosure of which is incorporated herein by reference in its entirety).

The cDNA SEQ ID NO:27 is composed of 5 exons. Exon 1 lies between nucleotides 1–245, exon2 lies between nucleotides 246–370, exon 3 lies between nucleotides 371–512, exon 4 lies between nucleotides 513–639, and exon 5 lies between nucleotides 640–762. Exons 2 to 5 of cDNA SEQ ID NO:27 are shared in part with XAGE-1. However, since the initiation codon of SEQ ID NO: 27 is located in intron1 of XAGE-1, there is a frameshift in the alignment of the 2 molecules. Exon 1 of SEQ ID NO:27 lies between nucleotides 110–234 of XAGE-1, exon 2 of SEQ ID NO:27 lies between nucleotides 235–376 of XAGE-1, exon 3 of SEQ ID NO: 27 lies between nucleotides 377–503 of XAGE-1, and exon 4 of SEQ ID NO:27 lies between nucleotides 504–526 of XAGE-1.

XAGE-1 is overexpressed in sarcoma and alveolar rhabdomyosarcoma and is also highly expressed in normal testis (Liu, X. F., L. J. Helman, et al. (2000). Cancer Res 60(17): 4752–5, the disclosure of which is incorporated herein by reference in its entirety). In addition XAGE-1 share homology with PAGE-4 (Brinkmann, U., G. Vasmatzis, et al. (1999) Cancer Res 59(7): 1445–8, the disclosure of which is incorporated herein by reference in its entirety) at the COOH end.

CT antigens are a distinct class of differenctiation antigens that are expressed by cancers arising in nonessential normal tissues such as prostate, breast, and ovary (G. Vasmatzis et al., Proc. Natl. Acad. Sci. USA, 95: 300–304, 1998, the disclosure of which is incorporated herein by reference in its entirety) and that have a restricted pattern of expression in normal tissues. This class of antigens are presented on the surface of tumor cells and are recognized by cytolytic T cells, leading to lysis. The extent to which these antigens have been studied, has been via cytolytic T cell characterization studies, in vitro i.e., the study of the identification of the antigen by a particular cytolytic T cell ("CTL" hereafter) subset. The subset proliferates upon recognition of the presented tumor rejection antigen, and the cells presenting the antigen are lysed. Characterization studies have identified CTL clones which specifically lyse cells expressing the antigens. Examples of this work may be found in Levy et al., Adv. Cancer Res. 24: 1–59 (1977); Boon et al., J. Exp. Med. 152: 1184–1193 (1980); Brunner et al., J. Immunol. 124: 1627–1634 (1980); Maryanski et al., Eur. J. Immunol. 124: 1627–1634 (1980); Maryanski et al., Eur. J. Immunol. 12: 406–412 (1982); Palladino et al., Canc. Res. 47: 5074–5079 (1987), the disclosures of which are incorporated herein by reference in their entireties.

Some throughly studied CT antigens are MAGE, BAGE, GAGE and LAGE, others have been added including PAGE, XAGE, most of them located on chromosome X. Brinkmann et Al reported the identification of three new members of the GAGE/PAGE family, termed XAGEs. XAGE-1 and XAGE-2 are expressed in Ewing's sarcoma, rhabdomyosarcoma, a breast cancer, and a germ cell tumor.

It is believed that the protein of SEQ ID NO:268 is a splicing variant of XAGE-1, a CT antigen overexpressed in Ewing sarcoma.

Accordingly, the present invention includes the use of the protein of SEQ ID NO:268, fragments comprising at least 5, 8, 10, 12, 15, 20, 25, 30, 35, 40, 50, 60, 75, 100, 150, or 200 consecutive amino acids thereof, or fragments having a desired biological activity to treat or ameliorate a condition, such as those listed above, associated with over or under expression of the protein of SEQ ID NO:268. In such embodiments, the protein of SEQ ID NO:268, or a fragment thereof, is administered to an individual in whom it is desired to increase or decrease any of the activity of the protein of SEQ ID NO:268. The protein of SEQ ID NO:268 or fragment thereof may be administered directly to the individual or, alternatively, a nucleic acid encoding the protein of SEQ ID NO:268 or a fragment thereof may be administered to the individual. Alternatively, an agent which increases the activity of the protein of SEQ ID NO:268 may be administered to the individual. Such agents may be identified by contacting the protein of SEQ ID NO:268 or a cell or preparation containing the protein of SEQ ID NO:268 with a test agent and assaying whether the test agent increases the activity of the protein. For example, the test agent may be a chemical compound or a polypeptide or peptide.

Alternatively, the activity of the protein of SEQ ID NO:268 may be decreased by administering an agent which interferes with such activity to an individual. Agents which interfere with the activity of the protein of SEQ ID NO:268 may be identified by contacting the protein of SEQ ID NO:268 or a cell or preparation containing the protein of SEQ ID NO:268 with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In one embodiment, the invention relates to methods and compositions using the protein of the invention or part thereof as a marker protein to selectively identify tissues, preferably testis and lungs, or to distinguish between two or more possible sources of a tissue sample on the basis of the level of the protein of SEQ ID NO:268 in the sample. For example, the protein of SEQ ID NO:268 or fragments thereof may be used to generate antibodies using any techniques known to those skilled in the art, including those described therein. Such tissue-specific antibodies may then be used to identify tissues of unknown origin, for example, forensic samples,differentiated tumor tissue that has metastasized to foreign bodily sites, or to differentiate different tissue types in a tissue cross-section using immunochemistry. In such methods a tissue sample is contacted with the antibody, which may be detectably labeled, under conditions which facilitate antibody binding. The level of antibody binding to the test sample is measured and compared to the level of binding to control cells from testis or lungs or tissues other than testis or lungs to determine whether the test sample is from testis or lungs. Alternatively, the level of the protein of SEQ ID NO:268 in a test sample may be measured by determining the level of RNA encoding the protein of SEQ ID NO:268 in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from testis or lungs or tissues other than testis or lungs to determine whether the test sample is from testis or lungs.

In another embodiment, antibodies to the protein of the invention or part thereof may be used for detection, enrichment, or purification of cells expressing the protein of SEQ ID NO:268, including Ewing sarcoma cells, rhabdomyosarcoma cells, breast cancer cells and germ cell tumor cells using methods known to those skilled in the art. For example, an antibody against the protein of SEQ ID NO:268 or a fragment thereof may be fixed to a solid support, such as a chromatograpy matrix. A prepartation containing cells expressing the protein of SEQ ID NO:268 is placed in contact with the antibody under conditions which facilitate binding to the antibody. The support is washed and then the cells are released from the support by contacting the support with agents which cause the cells to dissociate from the antibody.

In another embodiment of the present invention, the protein of SEQ ID NO:268 or a fragment thereof thereof may be used to diagnose disorders associated with altered expression of the protein of SEQ ID NO:268. In some embodiments, the protein of SEQ ID NO:268 or fragments thereof may be used to diagnose Ewing sarcoma, rhabdomyosarcoma, breast cancer or germ cell tumors. In such techniques, the level of the protein of SEQ ID NO:268 in an ill individual is measured using techniques such as those described herein. The level of the protein of SEQ ID NO:268 in the ill individual is compared to the level in normal individuals. An elevated level or decreased level of the protein of SEQ ID NO:268 relative to normal individuals suggests that the ill individual is suffering from a defect in intercellular communication or secretion.

Another embodiment of the invention relates to compositions and methods using the protein of SEQ ID NO:268 or a fragment thereof as possible targets for vaccine-based therapies of cancer, including Ewing sarcoma, rhabdomyosarcoma, breast cancer or germ cell tumors. In such embodiments, an antibody against against the protein of SEQ ID NO:268 or a fragment thereof is administered to an individual suffering from cancer in an amount sufficient to ameliorate or eliminate the cancer.

Protein of SEQ ID NO:399 (Internal Designation Clone 160-40-1-0-H4-CS)

The protein of SEQ ID NO:399 is encoded by the cDNA of SEQ ID NO: 158. Accordingly, it will be appreciated that all characteristics and uses of the polypeptide of SEQ ID NO:399 described throughout the present application also pertain to the polypeptide encoded by the human cDNA of clone 160-40-1-0-H4-CS. In addition, it will be appreciated that all characteristics and uses of the nucleic acid of SEQ ID NO:158 described throughout the present application also pertain to the human cDNA of clone 160-40-1-0-H4-CS.

The protein of SEQ ID NO:399 encoded by the cDNA of SEQ ID NO:158 is homologous to proteins of the Phosphatidic Acid Phosphatase type 2 (PAP2) superfamily (Stukey J. and Carman G. M., Protein Sci 1997;6:469–472, the disclosure of which is incorporated herein by reference in its entirety). Three variants of human PAP, i.e. PAP-alpha 2 (W79285) and its alternatively spliced form PAP-alpha 1 (W79284), PAP-beta (W79286) and PAP-gamma (W79287) have been identified. The protein of SEQ ID NO:399 displays a pfam characteristic domain of the PAP2 superfamily from positions 19 to 175. Accordingly, one embodiment of the present invention is a polypeptide comprising amino acid residues 19 to 175 of SEQ ID NO:399. Four membrane spanning domains are predicted from amino acid positions 17 to37, 47 to 67, 108 to 128, and 141 to 161. Accordingly, another embodiment of the present invention is a polypeptide comprising one or more of the foregoing membrane spanning domains. A preferred embodiment of the invention is directed toward the compositions of SEQ ID NO:158, SEQ ID NO:399, and Clone 160-40-1-0-H4-CS. The protein of SEQ ID NO:399 is hereby referred to as Phosphatidic Acid Phosphatase (PAP)7.

PAP7 is known to be an important enzyme for glycerolipid biosynthesis. In particular, PAP catalyzes the conversion of phosphatidic acid (PA) into diacylglycerol (DAG). Therefore, the biological activity of PAP7 is defined as the catalysis of said conversion reaction. PA and DAG are lipids involved in signal transduction and in structural membrane-lipid biosynthesis in cells, thus they represent an important regulatory point in eukariotic phospholipid metabolism. DAG is a well-studied lipid second messenger which is essential for the activation of protein kinase C (Kent; Anal. Rev. Biochem.; 64:315–343;1995) whereas PA itself is also a lipid messenger implicated in various signaling pathways such as NADPH oxidase activation and calcium mobilization (English; Cell Signal.; 8:341–347;1996, the disclosure of which is incorporated herein by reference in its entirety). The regulation of PAP7 activity can therefore affect the balance of divergent signaling processes that the cell receives in terms of PA and DAG (Brindley et al.; Chem.Phys. Lipids 80:45–57; 1996, the disclosure of which is incorporated herein by reference in its entirety).

PAP7 expression is suppressed in tumor tissues, indicating that PAP7 has tumor suppressor activity. Furthermore, PAP7 activity is lower in fibroblast cell lines transformed with either the ras or fps oncogene. As discussed above, a decrease in PAP7 activity in transformed cells correlates with a concomitant increase in PA concentration. Elevated PAP7 activity and lower levels of PA have been observed in contact-inhibited fibroblasts relative to proliferating and transformed fibroblasts. Therefore, PAP7 polypeptides or fragments thereof may be used to inhibit cell proliferation and as such can provide a useful tool in treating cancers. Accordingly, in a preferred embodiment of the present invention, PAP7 polypeptides, fragments thereof, or a polynucleotide construct comprising polynucleotides encoding PAP7 polypeptides are used to inhibit cell proliferation. This method comprises the step of contacting a cell with a biologically active amount of PAP7 polypeptides or fragments thereof. Preferred cells include cancerous and precancerous cells, for example, colon carcinoma cells. A preferred method of delivering PAP7 polypeptides to a cell comprises introducing a polynucleotide construct comprising polynucleotides encoding said polypeptide to a specific cell. Polynucleotides may be introduced by methods common to the art such as transfection of electroporation. Additionally, polynucleotide delivery may be accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety. These delivery methods may further include a targeting molecule for polynucleotide delivery to a particular cell type, for example, CD40 ligand for targeting to a B cell tumor. Contacting the polynucleotide construct with a specific cell is accomplished by methods common to the art such as injection or inhalant (U.S. Pat. No. 6,110,490, P.C.T. 9704748, and U.S. Pat. No. 6,034,062 which disclosures are hereby incorporated by reference in their entireties). A further preferred method of delivering PAP7 polypeptides or fragments thereof to a cell comprises the steps: i) packaging a biologically active PAP7 polypeptide into a lipid vesicle; ii) targeting the lipid vesicle to specific cells, for example, by including a member of a receptor-receptor ligand pair in the lipid envelope; iii) embedding a fusogenic component such as a peptide in the lipid envelope to promote delivery of encapsulated polypeptides to target cells; and iv) contacting the targeted vesicle with specific cells by injection or inhalant (P.C.T 9704748 and U.S. Pat. No. 6,034,062 which disclosures are hereby incorporated by reference in their entireties).

In another embodiment of the present invention, the protein of SEQ ID NO:399 can be used to counterbalance the inflammatory response. PA has been implicated in cytokine induced inflammatory responses (Bursten et al; Circ. Shok 44: 14–29, 1994; Abraham et al; J. Exp. Med. 181: 569–575, 1995; Rice et al; PNAS 91: 3857–3861, 1994; Leung et al; PNAS 92: 4813–4817, 1995, the disclosures of which are incorporated herein by reference in their entireties) and the modulation of numerous protein kinases involved in signal transduction (English et al; Chem. Phys. Lipids 80: 117–132, 1996, the disclosure of which is incorporated herein by reference in its entirety). In addition, a nucleic acid encoding the protein of SEQ ID NO:399 or a fragment thereof may be used to counterbalance the inflammatory response from cytokine stimulation through degradation of excess amount of PA in cells or to treat or ameliorate inflammatory diseases.

PAP7 plays an active role in the hydrolysis and uptake of lipids from the extracellular space. Accordingly, the level or activity of PAP7 may be modulated to influence the rate or extent of hydrolysis and uptake of lipids from the extracellular space. Furthermore, PAP7 activity is decreased in the livers and hearts of grossly obese and insulin resistant rats compared to the control lean phenotype. PAP7 therefore can provide an important tool for the treatment of obesity associated with diabetes. In a preferred embodiment of the invention, PAP7 polypeptides, fragments thereof, or a polynucleotide construct comprising polynucleotides encoding said polypeptides are contacted with a cell to increase lipid uptake from the extracellular space. This method may be applied to treat obesity and diabetes-related obesity. Preferred cells include those involved in lipid metabolism such as those of the heart and liver. This method comprises the step of contacting a cell with a biologically active amount of PAP7 polypeptides or fragments thereof. Delivery methods include those common to the art such as those discussed herein. For example, a lipid vesicle comprising a polynucleotide construct comprising polynucleotides encoding PAP7 polypeptides may be targeted to a liver cell via an asialoglycoprotein receptor targeting moiety.

Accordingly, the present invention includes the use of PAP7 polypeptides, fragments thereof, or fragments having a desired biological activity to treat or ameliorate a condition, such as those listed above, in an individual. In such embodiments, PAP7 polypeptides, or fragments thereof, are administered to an individual in whom it is desired to increase any of the activities of PAP7, including glycerolipid biosynthesis, conversion of phosphatidic acid into diacylglycerol, signal transduction, membrane-lipid biosynthesis, activation of protein kinase C, NADPH oxidase activation, calcium mobilization, cell division, production of diacylglycerol, monoacylglycerol, ceramide or sphingosine, modulation of the inflammatory response or dephosphorylation of a substrate such as lysophosphatidic acid, ceramide 1-phosphate, or sphingosine 1-phosphate, or treatment or amelioration of obesity associated with diabetes. PAP7 or fragments thereof may be administered directly to the individual or, alternatively, a polynucleotide construct comprising polynucleotides encoding PAP7 polypeptides or fragments thereof may be administered to the individual. Alternatively, an agent which increases the biological activity of PAP7 polypeptides may be administered to the individual. Such agents may be identified by contacting PAP7 polypeptides or a cell or preparation comprising PAP7 polypeptides with a test agent and assaying whether the test agent increases the activity of the protein. For example, the test agent may be a chemical compound or a polypeptide.

Alternatively, PAP7 biological activity may be decreased by administering an agent which interferes with such activity to an individual. Agents which interfere with said biological activity may be identified by contacting PAP7 polypeptides, fragments thereof, or a cell or preparation comprising PAP7 polypeptides with a test agent and assaying whether the test agent decreases the activity of the protein. For example, the agent may be a chemical compound, a polypeptide or peptide, an antibody, or a nucleic acid such as an antisense nucleic acid or a triple helix-forming nucleic acid.

In a preferred embodiment of the invention, PAP7 polypeptides or fragments thereof are used to generate antibodies using any technique known to those skilled in the art. In a further preferred embodiment, an antibody is contacted with a cell or biological sample for purposes of identification and diagnosis. For example, said antibody may be used to identify tissues and diagnose PAP7-related disorders. Such disorders include tumor predisposition, tumors, metastasized tumors, tumor-invaded tissues, predisposition to lipid uptake disorders, and lipid uptake disorders such as obesity. Detection of PAP7 polypeptides or fragments thereof with said antibody is accomplished by methods common to the art such as immunohistochemistry or ELISA. Alternatively, the level of PAP7 expression in a test sample may be measured by determining the level of RNA encoding PAP7 polypeptide in the test sample. RNA levels may be measured using nucleic acid arrays or using techniques such as in situ hybridization, Northern blots, dot blots or other technques familiar to those skilled in the art. If desired, an amplification reaction, such as a PCR reaction, may be performed on the nucleic acid sample prior to analysis. The level of RNA in the test sample is compared to RNA levels in control cells from brain or tissues other than brain to determine whether the test sample is from brain.

Protein of SEQ ID NOs:258 and 262 (Internal Designations 110-007-1-0-C7-CS, 116-055-1-0-A3-CS):

The protein of SEQ ID NO:258 is encoded by the cDNA of SEQ ID NO:17. Accordingly, it will be appreciated that all characteristics and uses of the polypeptide of SEQ ID NO:258 described throughout the present application also pertain to the polypeptide encoded by the human cDNA of clone 110-007-1-0-C7-CS. In addition, it will be appreciated that all characteristics and uses of the nucleic acid of SEQ ID NO:17 described throughout the present application also pertain to the human cDNA of clone 110-007-1-0-C7-CS. The protein of SEQ ID NO: 258 shows homologies to two high affinity IgE receptor-like proteins (IGER) with GENESEQP accession numbers W96745 and W41056, the disclosures of which are incorporated herein by reference in their entireties. The protein of SEQ ID NO:258 is expressed in liver and testis. The protein of SEQ ID NO:262, encoded by SEQ ID NO:21, is a variant of the protein of SEQ ID NO:258 and shares all the potential uses and functions described herein. This protein and cDNA share all of the characteristics and uses of the clone, and product thereof, 116-055-1-0-A3-CS). A preferred embodiment of the invention is directed toward the compositions of SEQ ID NO: 17, SEQ ID NO:258, Clone 110–007–1-0-C7-CS, SEQ ID NO: 21, SEQ ID NO: 262, and Clone 116-055-1-0-A3-CS.

The proteins of SEQ ID NO:258 and SEQ ID NO:262 are called the Allergen Effector Receptor (AER). AER belongs to the high affinity immunoglobulin E (IgE) receptor-like family. Similar to other high affinity IgE receptor-like proteins, the AER polypeptide contains four transmembrane spanning domains of 20 amino acids, between amino acids 53–73, 79–99, 121–141 and 158–178, respectively. The AER polypeptide crosses the plasma membrane four times forming two small extracellular loops and has both the N- or C-terminals in the cytoplasm. Moreover, the protein of the invention contains a signal peptide (cleavage site at position 21). The biological activity of AER is defined as the ability to bind IgE proteins or antigens bound to IgE and cause a cellular response as discussed herein.

Atopic diseases, which include allergy, asthma, atopic dermatitis (or eczema) and allergic rhinitis are generally defined as a disorder of IgE responses to common antigens, such as pollen or house dust mites. Said disorder is frequently detected by elevated total serum IgE levels, antigen specific IgE response, or positive skin tests to common allergens. In principle, atopy results from dysregulation of any part of the pathway: antigen exposure; IgE response and antigen binding; interaction of IgE with AER polypeptides on the surface of cells such as mast cells, B cells, or T cells; and the subsequent cellular activation mediated by that ligand-receptor engagement. Therefore, inhibition of AER biological activity is desired to prevent the disorders listed above.

In a preferred embodiment of the invention, AER polypeptides, fragments thereof, or polynucleotides encoding said polypeptides are used to identify agents that play a role in atopic diseases for purposes of drug design. This method comprises the steps: i) expressing an AER polypeptide in a cell; ii) exposing an AER polypeptide to an appropriate ligand (such as an IgE-antigen complex); iii) detecting downstream effectors of AER-ligand binding; iv) and screening for or designing compounds to inhibit said downstream effectors. Preferred cells include those that are responsive to AER signaling such as mast cells, B cells, and T cells. Expression of AER polypeptides may be accomplished in a cell by introducing a polynucleotide construct comprising polynucleotides encoding AER polypeptides to the cell by methods common to the art such as transfection or electroporation. Detection of downstream effectors is also carried out by methods common to the art such as subtractive RNA hybridization or gene chip analysis.

In a preferred embodiment of the invention, AER polypeptides or fragments thereof are used to generate antibodies, such as monoclonal antibodies, according to methods known in the art. In a further preferred embodiment, antibodies that bind AER polypeptides or fragments thereof are used to inhibit AER biological activity. This method is directed toward treatment or prevention of atopic diseases such as allergies, asthma, atopic dermatitis (or eczema) and allergic rhinitis. Preferred antibodies bind extracellular regions of AER polypeptides. Further preferred antibodies bind AER polypeptides such that IgE or IgE-bound antigen can no longer interact with AER. Further preferred antibodies are those that bind AER polypeptides and prevent cellular responses mediated by AER. This method comprises the step of contacting an AER-binding antibody in a physiologically acceptable solution (such as pH-buffered isotonic solutions) with a cell. Preferred cells are those that express AER polypeptides such as mast cells, T cells, or B cells. Delivery of said antibody to the appropriate site is accomplished by methods common to the art including injection or inhalant as described in U.S. Pat. Nos. 6,177,433 and 6,034,062, which disclosures are hereby incorporated by reference in their entireties.

In a preferred embodiment of the invention, AER polypeptides or fragments thereof are used to screen test compounds for inhibitors of AER biological activity. This method is also directed toward treatment or prevention of atopic diseases. This method comprises the steps: i) expressing an AER polypeptide in a cell; ii) exposing said AER-expressing cell to a test compound; iii) exposing an AER polypeptide to an appropriate ligand (such as an IgE-antigen complex); iii) detecting AER biological activity; and iv) comparing AER biological activity with the test compound to control AER biological activity in the absence of test compound. Preferred cells include those that are responsive to AER signaling such as mast cells, B cells, and T cells. Expression of AER polypeptides is accomplished in a cell by introducing a polynucleotide construct comprising polynucleotides encoding AER polypeptides to the cell by methods common to the art such as transfection or electroporation. AER biological activity is detected by methods common to the art. For example, an AER-expressing cell may be exposed to a fluorescent antibody that recognizes IgE. Detection of fluorescence would indicate IgE binding to AER on that cell. As an additional example, known AER-mediated cell responses, such as degranulation of mast cells or secretion of cytokines by B and T cells, are detected using methods common to the art such as ELISA. Preferred test compounds include antibodies that bind AER and block its biological activity.

In a preferred embodiment of the invention, inhibitors of AER biological activity are used to treat or prevent atopic diseases. This method comprises the step of contacting said inhibitor in a physiologically acceptable solution (e.g., pH-buffer isotonic solutions) with a cell. Preferred cells include those responsive to AER signaling such as mast cells. Delivery of said inhibitor may be accomplished by methods common to the art including injection or inhalant as described in U.S. Pat. Nos. 6,177,433 and 6,034,062, which disclosures are hereby incorporated by reference in their entireties.

In a preferred embodiment of the invention, compounds that bind to AER are used to identify AER-expressing cells such as mast cells and/or diagnose atopy, including hereditary atopy. This method comprises the steps of contacting a cell with said compound and detecting binding. Contact of said compound with a cell is accomplished, for example, in a biological fluid sample or a histological medium. Preferred compounds include antibodies that bind AER polypeptide. Binding is detected by methods common to the art such as fluorescent labeling of the compound, immunohistochemistry, or other secondary detection methods.

Alternatively, a nucleic acid sample may be obtained from a test individual and analyzed to determine whether it contains a level of RNA encoding AER polypeptides which is associated with hereditary atopy or a mutation in the gene encoding AER polypeptide which is associated with hereditary atopy. For example, a nucleic acid sample from the test individual may be contacted with a polynucleotide probe comprising polynucleotides encoding AER polypeptide or a fragment thereof to determine the RNA level or whether the individual has a mutation associated with hereditary atopy. The probe may be either DNA, including cDNA or genomic DNA, or the probe may be RNA. Any of the methods familiar to those skilled in the art may be used in these diagnostic methods, including the methods described herein. For example, the presence of a mutation associated with hereditary atopy can be determined using methods generally known in the art, such as but not limited to PCR, sequencing or mini sequencing as described in the method of Yamamoto et al. (Biochem. Biophys. Res. Comm., 182:507 (1992), the disclosure of which is incorporated by reference herein in its entirety).

Protein of SEQ ID NO:279 (Internal Designation 160-58-3-0-H3-CS)

The protein of SEQ ID NO:279, proEnkephalin 16 (pEnk16), is encoded by the cDNA of SEQ ID NO:38. Accordingly, it will be appreciated that all characteristics and uses of the polypeptide of SEQ ID NO:279 described throughout the present application also pertain to the polypeptide encoded by a nucleic acid included in clone 160-58-3-0-H3-CS. In addition, it will be appreciated that all characteristics and uses of the nucleic acid of SEQ ID NO:38 described throughout the present application also pertain to the nucleic acid included in clone 160-58-3-0-H3-CS.

pEnk16 is encoded by a nucleic acid of 1330 nucleotides with an ORF between nt 198 to 998 yielding a 267 amino acid protein. The protein is a variant of the sequence (SP:P01210) for proenkephalin A precursor which contains Met- and Leu-enkephalins. Met- and Leu-enkephalins are proteolytic pentapeptide products of proenkephalins that compete with and mimic the effects of opiate drugs. pENK16 is processed to produce the following peptides which include Met-enkephalin (6 copies, 2 of which are extended) and Leu-enkephalin:

Signal peptide 1–24
Peptide 100–104 Met-enkephalin 1
Peptide 107–111 Met-enkephalin 2
Peptide 136–140 Met-enkephalin 3
Peptide 186–193 Met-enkephalin-arg-gly-leu
Peptide 210–214 Met-enkephalin 4
Peptide 230–234 Leu-enkephalin
Peptide 261–267 Met-enkephalin-arg-phe.

PSORT gives a predicted extracellular localization, including the cell wall (66.7%).

Enkephalins are widely distributed throughout the central nervous system in enkephalinergic neuronal networks, and also exist in the peripheral nervous system, for example in autonomic ganglia. pENK16 polypeptides and fragments thereof are involved in the modulation of pain perception, in mood and behaviour, learning and memory, responses to stress, diverse neuroendocrine functions, immune regulation and cardiovascular and respiratory function. pENK16 polypeptides and fragments thereof bind to opiate receptors, primarily of the delta type. They also bind mu and kappa opiate receptors, as well as the immunoglobulin superfamily member OBCAM (Schofield et al, EMBO J 8, 489–495, 1989, the disclosure of which is incorporated herein by reference in its entirety) and somatostatin receptors (PCT publication WO96/06863, the disclosure of which is incorporated herein by reference in its entirety) which are homologous receptors. Therefore pEnk16 is vital for pain perception, anxiety, and aggressiveness. Altered levels of enkephalins may produce psychological disease. Indeed, the pENK16 gene is localized to Chromosome 8q23–24, the same locus on which are found genes related to epilepsy and spastic paraplegia. Accordingly, in a preferred embodiment of the invention, pENK16 polypeptides or fragments thereof are used for the treatment of pain or psychological disorders, especially those involving distortion in the perception of pain, aggressiveness, or anxiety. This would include drug addiction, different types of phobias, panic attacks, schizophrenia, bi-polar, anorexia nervosa, chronic pain disorders, post-traumatic events, post-operative pain management or other analgesic-requiring disorders. This method comprises the step of contacting pENK16 polypeptides or fragments thereof with a cell. Preferred cells include those that express opioid receptors, such as cells of the central and peripheral nervous system or derivatives of those cells.

Delivery of pENK16 polypeptides or fragments thereof is accomplished by methods that include but are not limited to: injecting said polypeptides in a physiologically acceptable solution (such as pH-buffered saline) directly to a site or into cerebrospinal fluid; packaging of said polypeptides into nanoparticles capapble of passing the blood-brain barrier (U.S. Pat. No. 6,117,454, the disclosure of which is incorporated herein in its entirety); or conjugating said polypeptides to a fatty acid carrier capable of passing the blood-brain barrier (U.S. Pat. No. 4,933,324, the disclosure of which is incorporated herein in its entirety). Alternatively, pENK16-derived peptides may be delivered directly to the blood stream in a physiologically acceptable solution as these neuropeptides are able to pass the blood-brain barrier (U.S. Pat. No. 4,902,505, the disclosure of which is incorporated herein in its entirety). pENK polypeptides or fragments thereof may be delivered alternatively by a polynucleotide construct comprising polynucleotides encoding said polypeptides. Polynucleotide delivery is accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety.

Administration of pENK16 affects several immunologic functions, including antibody production, NK cell activity against tumors and viral infections, macrophage and polymorphonuclear leukocyte functions, graft rejections, and mitogen-stimulated lymphocyte proliferation. The effects can be bi-directional, where low concentrations enhance, and high concentrations inhibit the same immune function. Thus, enkephalins are modulators of immune reactions. Met-enkephalin enhances the immune reaction in patients with cancer or AIDS. It can bind opioid receptors present in peripheral inflamed tissues to mediate an analgesic effect. Accordingly, in a preferred embodiment of the present invention, pENK16 polypeptides or fragments comprising at least 5, 8, 10, 12, 15, 20, 25, 30, 35, 40, 50, 60, 75, 100, 150, or 200 consecutive amino acids thereof, are used to treat immune disorders. This method comprises the step of administering pENK16 polypeptide or fragments thereof directly to the individual or, alternatively, administering a polynucleotide cassette comprising polynucleotides encoding said polypeptides by methods common to the art including those included herein. Alternatively, an agent which increases the activity of endogenous pENK16 polypeptides or fragments thereof is administered to the individual.

In another embodiment of the present invention, pENK16 polypeptides or fragments thereof are used to make antibodies. These antibodies may be used in methods to inhibit pENK16 activity, for example, by interfering with receptor binding, or to detect pENK polypeptides or fragments thereof, for example, to diagnose disorders associated with altered expression of pENK16. In a further embodiment of the invention, antibodies that bind pENK16 polypeptides or fragments thereof are used to detect said polypeptides in an individual using techniques common to the art such as fluorescent labeling of the antibody. The level of pENK16 polypeptides or fragments thereof in the individual may be compared to the level in normal individuals to determine whether the individual has an abnormal level of pENK16 polypeptides associated with disease.

Enkephalins also have anti-bacterial activity. pENK16 protein processing involves removal of the carboxy-terminal end. Further processing results in a bisphosphorylated peptide of about 30 amino acids (ENK16BPP) which possesses antibacterial activity against gram-positive bacteria such as *Staphylococcus aureus, Micrococcus luteus* and *Bacillus megaterium* (0.2–0.4 µM range). ENK16BPP is present in wound fluids along with other known antibacterial peptides (defensins, bactenecins). The concentrations were in a range similar to that found to be active in vitro (0.5–1 µM). ENK16BPP is detected in secretions from human polymorphonuclear neutrophils and cultured chromaffin cells following stimulation. Co-release of met-enkephalin and ENK16BPP represent a unified neuroimmune protective response to stress situations and infectious diseases providing a beneficial survival strategy at the begninning of proinflammatory processes. pENK16 therefore plays an important role in host defense against microbial infections, especially those involving gram positive bacteria, inflammatory processes, and wound repair. In a preferred embodiment of the invention, an antibiotic effective amount of pENK16 polypeptides and fragments thereof are used to prevent microbial infection. Preferred pENK16 fragments include ENK16BPP. This method comprises the step of contacting pENK16 polypeptides or fragments thereof in a physiologically acceptable solution (e.g., pH-buffered saline) with areas of microbial infection or possible microbial infection, including wounds and incisions. Further methods include using pENK16 or fragments thereof as antibacterial agents in creams/ointments/solutions, pre-soaked bandages, or dermal-type patches for external applications. Alternatively, pENK16 polypeptides or fragments thereof may be used in injections (intravenously, subcutaneously or intra-peritoneally). This is useful for wound repair, burn healing, post-operative recovery management. Alternatively, pENK16 polypeptides or fragments thereof are incorporated into disinfectant solutions used for cleaning surfaces such as the kitchen, bathroom, desktops, phones, computer keyboards or mouse.

pENK16 and/or its proteolytic products act as extracellular and/or cell surface membrane bound factors that inhibit apoptosis. The receptor(s) to which these factor(s) bind are related, or possibly identical, to one or more members of the opioid receptor family. Once internalized, cytoplasmic proenkephalin and/or its proteolytic products act as general repressors of apoptosis. Accordingly, in a preferred embodiment of the invention, pENK16 polypeptides or fragments thereof are used to inhibit apoptosis of a cell. Preferred cells are those that express opioid receptors, the OBCAM receptor, or somatostatin receptors such as neuronal cells. This method comprises the step of contacting an apoptosis-inhibiting effective amount of pENK16 polypeptides or fragments thereof with a cell. This may be accomplished in vitro, in situ, or in vivo. For in vivo applications, pENK 16 polypeptides or fragments thereof are delivered by methods common to the art such as those discussed herein.

Agents that bind and neutralize extracellular pENK16 polypeptides or fragments thereof would induce apoptosis. In a preferred embodiment of the invention, pENK16 polypeptides or fragments thereof are used to screen test molecules that bind said polypeptides and interfere with the ability of said polypeptides to bind receptors. Preferred test molecules include antibodies. This method comprises the steps of: contacting a pENK16 polypeptide or fragment thereof with a test molecule; detecting binding of said test molecule to said polypeptide; and determining ability of said polypeptide to bind a receptor. This screen may be accomplished by methods common to the art, such as ELISA and competition assays.

In a preferred embodiment of the invention, antibodies or other molecules that abrogate binding of pENK16 polypeptides or fragments thereof to receptors are used to induce apoptosis. This method comprises the step of contacting said antibody or molecule with a cell. Methods of delivery to specific cells include those common to the art such as those discusses herein. This method can be used for example, to treat cancer, preferably cancers of cells that express receptors that recognize pENK16 polypeptides or fragments thereof. The agents may be administered in combination with a genotoxic or cell cycle arrest agent. Alternatively, the agent may be complexed with a chemotherapeutic or irradiation treatment.

Protein of SEQ ID NO: 293 (Internal Designation 181-16-1-0-G7-CS)

The cDNA of Clone 181-16-1-0-G7-CS encodes the Polarizing Cytokine Processing (PCP)-1 protein of SEQ ID NO:293. Accordingly, it will be appreciated that all characteristics and uses of the polypeptides of SEQ ID NO:293 described throughout the present application also pertain to the polypeptides encoded by the nucleic acids included in Clone 181-16-1-0-G7-CS. A preferred embodiment of the invention is directed toward the compositions of SEQ ID NO:293 and Clone 181-16-1-0-G7-CS.

The PCP-1 polypeptidehas a high degree of homology with HSPC163 (Genbank accession number AF161512), the protein encoded by gene no:93 (PCT/US99/17130), and the human cornichon protein TGAM77. The PCP-1 polypeptide has two transmembrane domains and a short cytoplasmic tail, and thus shares structural similarity to type IIIa membrane proteins.

PCP-1 polypeptides are expressed in activated T-cells, T cell helper II cells, granulocytic cells, monocytic cells, Raji cells treated with cyclohexamide, and CD34+ hematopoetic stem cells. This expression pattern indicates that PCP-1 polypeptides play a role in regulating the proliferation, survival, differentiation, and activation of hematopoetic cells. Furthermore, PCP-1 polypeptide is involved in regulation of cytokine and growth factor production and processing, suggesting a mechanism for these activities. In a preferred embodiment of the invention, PCP-1 polypeptides, fragments thereof, or polynucleotides encoding said polypeptides are used to increase cytokine/growth factor secretion. Preferred cytokines are members of the Epithelial Growth Factor (EGF) and Transforming Growth Factor (TGF) families, in particular, EGF and TGF-α. This method comprises the step of introducing PCP-1 polypeptides to a cell. Preferred cells are those that secrete cytokines. Further preferred cells are those that secrete EGF or TGF-α. A preferred method of introducing PCP-1 polypeptides to a cell includes introducing a polynucleotide construct comprising polynucleotides encoding a PCP-1 polypeptide to said cell by methods common to the art such as transfection or electroporation. Further methods of polynucleotide introduction include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety.

In another embodiment of the invention, PCP-1 polypeptides, fragments thereof, or polynucleotides encoding said polypeptides are introduced into autologous cells obtained from an individual for the purpose of reintroducing cytokine-producing cells. This method is directed toward treatment of cytokine-deficiency disorders. Preferred cells include cells capable of producing cytokines, in particular T cells. Introduction of PCP-1 polypeptides or polynucleotides is accomplished by methods common to the art, such as those discussed above. After introduction of said polypeptides or polynucleotides, cells are expanded and reintroduced into the individual from which the cells were obtained (U.S. Pat. Nos. 5,192,537 and 5,766,920, which disclosures are hereby incorporated by reference in their entireties).

In another embodiment of the subject invention, PCP-1 polypeptides, fragments thereof, and polynucleotides encoding said polypeptides are used to expand stem cells, committed progenitors of various blood lineages, and in the differentiation and/or proliferation of various cell types. This method comprises the step of introducing PCP-1 polypeptides to a cell. Preferred cells are hematopoetic cells. Further preferred cells are hematopoetic stem cells. Introduction of PCP-1 polypeptides is accomplished as discussed above.

PCP-1 polypeptides are expressed in tumor cells including cells from renal carcinomas, skin melanomas, prostate, breast, and endometrial tumors. PCP-1 polypeptides are involved in production and processing of cytokines and growth factors, which are often associated with tumorogenesis. In a preferred embodiment of the invention, PCP-1 polypeptides are used to screen test compounds for inhibitors PCP-1-mediated cytokine/growth factor secretion. This method is directed toward inhibiting initiation and progression of tumors. This method comprises the steps: i) expressing a PCP-1 polypeptide in a cell; ii) exposing said PCP-1-expressing cell to a test compound; iii) detecting PCP-1-mediated cytokine/growth factor secretion; and iv) comparing PCP-1-mediated cytokine/growth factor secretion with the test compound to that found in the absence of test compound. Preferred cells include those secrete cytokines or growth factors. Further preferred cells are those that secrete cytokines or growth factors processed by PCP-1 polypeptides, such as EGF or TGF-α. Expression of PCP-1 polypeptides may be accomplished in a cell by introducing a polynucleotide construct comprising polynucleotides encoding PCP-1 polypeptides to the cell by methods common to the art such as transfection or electroporation. Cytokine or growth factor secretion is detected by methods common to the art such as ELISA. Preferred test compounds include antibodies that bind PCP-1 polypeptides or fragments thereof. In a further preferred embodiment of the invention, inhibitors of PCP-1 polypeptide activity are used to inhibit initiation and progression of tumors. This method comprises contacting a PCP-1 polypeptide inhibiting amount of PCP-1 polypeptide inhibitor with a cell suspected of contributing to predisposition to a tumor phenotype or display of tumor phenotype as determined by methods common to the art including those discussed herein. Said inhibitor is contacted with a cell in a physiologically acceptable solution (e.g., a pH-buffered, isotonic solution) directly, topically, by injection, catheter, or other method as determined appropriate by one skilled in the art.

PCP-1 polypeptides are highly expressed in brain tissue and play a role in directional patterning, neuronal differentiation, and synapse formation. In a further embodiment of the invention, PCP-1 polypeptides are contacted with a neuronal cell to treat or prevent disorders involving directional patterning, neuronal differentiation, or synapse formation. This method is directed toward treatment of disorders such as Alzheimers, Parkinsons, and Huntingtons diseases, Tourette Syndrome, schizophrenia, mania, demntia, paranoia, obsessive compulsive disorder, panic disorder, psychoses, and learning or behavioral disorders. This method comprises the steps of introducing PCP-1 polypeptides to a neuronal cell suspected of predisposition to or displaying pathology of neural disorders or abnormal PCP-1 expression, as determined by methods common to the art including those discussed herein. As an example of this method, polypeptides or fragments thereof are introduced into a cell with a polynucleotide construct comprising polynucleotides encoding said polypeptides. Polynucleotide delivery is accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety. Such vectors may be targeted to cross the blood brain barrier by incorporation of a neural-specific targeting moiety, for example, a neuropeptide such as a dopamine derivative.

In a preferred embodiment of the invention, PCP-1 polypeptides or fragments thereof are used to produce antibodies according to methods well known in the art. The antibodies can be monoclonal or polyclonal. In a further preferred embodiment of the invention, antibodies that bind PCP-1 polypeptides or fragments thereof are used for purposes including identification of PCP-1 expressing cells and diagnosis of PCP-1-related disorders. This method comprises the steps of contacting said antibodies with a cell and detecting binding of said antibodies. For example, antibodies are contacted with sample cells in a biological fluid, biopsy, or histological medium. Detection of antibody binding is accomplished by methods common to the art such as visualization of a fluorescent antibody label. This method is applied, for example, to diagnose tumors such as those discussed above. In addition, this method may be applied to diagnosing tumor predisposition based on abnormal PCP-1 polypeptide expression. In addition, this method may be applied to diagnosing neuronal disorders, such as those discussed above, based on abnormal PCP-1 polypeptide expression. Furthermore, this method may be applied to identifying activated hematopoetic cells such as T cells.

Protein of SEQ ID NO:316 (Internal Designation 188-45-1-0-D9-CS)

The Polarizing Cytokine Processing (PCP)-2 protein of SEQ ID NO:316 is encoded by the cDNA of SEQ ID NO:75. Accordingly, it will be appreciated that all characteristics and uses of the polypeptide of SEQ ID NO:316 described throughout the present application also pertain to the polypeptide encoded by a nucleic acid included in clone 188-45-1-0-D9-CS. In addition, it will be appreciated that all characteristics and uses of the nucleic acid of SEQ ID NO:75 described throughout the present application also pertain to the nucleic acid included in clone 188-45-1-0-D9-CS. A preferred embodiment of the invention is directed toward the compositions of SEQ ID NO:75, SEQ ID NO:316, and clone 188-45-1-0-D9-CS.

PCP-2 contains three membrane-spanning segments located between amino acid positions 6 and 26, 73 and 93, or 139 and 159 and a signal peptide comprising the sequence FAAFCYMLSLVLC/AA. Accordingly, one embodiment of the present invention is a polypeptide comprising one or more of the membrane-spanning segments, and/or the signal peptide. PCP-2 is a member of the comichon protein family.

PCP-2 polypeptides are expressed in activated T-cells, T cell helper II cells, granulocytic cells, monocytic cells, Raji cells treated with cyclohexamide, and CD34+ hematopoetic stem cells. This expression pattern indicates that PCP-2 polypeptides play a role in regulating the proliferation, survival, differentiation, and activation of hematopoetic cells. Furthermore, PCP-2 polypeptide is involved in regulation of cytokine and growth factor production and processing, suggesting a mechanism for these activities. In a preferred embodiment of the invention, PCP-2 polypeptides, fragments thereof, or polynucleotides encoding said polypeptides are used to increase cytokine/growth factor secretion. Preferred cytokines are members of the Epithelial Growth Factor (EGF) and Transforming Growth Factor (TGF) families, in particular, EGF and TGF-α. This method comprises the step of introducing PCP-2 polypeptides to a cell. Preferred cells are those that secrete cytokines. Further preferred cells are those that secrete EGF or TGF-α. A preferred method of introducing PCP-2 polypeptides to a cell includes introducing a polynucleotide construct comprising polynucleotides encoding a PCP-2 polypeptide to said cell by methods common to the art such as transfection or electroporation. Further methods of polynucleotide introduction include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety.

In another embodiment of the invention, PCP-2 polypeptides, fragments thereof, or polynucleotides encoding said polypeptides are introduced into autologous cells obtained from an individual for the purpose of reintroducing cytokine-producing cells. This method is directed toward treatment of cytokine-deficiency disorders. Preferred cells include cells capable of producing cytokines, in particular T cells. Introduction of PCP-2 polypeptides or polynucleotides is accomplished by methods common to the art, such as those discussed above. After introduction of said polypeptides or polynucleotides, cells are expanded and reintroduced into the individual from which the cells were obtained (U.S. Pat. Nos. 5,192,537 and 5,766,920, which disclosures are hereby incorporated by reference in their entireties).

In another embodiment of the subject invention, PCP-2 polypeptides, fragments thereof and polynucleotides encoding said polypeptides are used to expand stem cells, committed progenitors of various blood lineages, and in the differentiation and/or proliferation of various cell types. This method comprises the step of introducing PCP-2 polypeptides to a cell. Preferred cells are hematopoetic cells. Further preferred cells are hematopoetic stem cells. Introduction of PCP-2 polypeptides is accomplished as discussed above.

PCP-2 polypeptides are expressed in tumor cells including cells from renal carcinomas, skin melanomas, prostate, breast, and endometrial tumors. PCP-2 polypeptides are involved in production and processing of cytokines and growth factors, which are often associated with tumorogenesis. In a preferred embodiment of the invention, PCP-2 polypeptides are used to screen test compounds for inhibitors PCP-2-mediated cytokine/growth factor secretion. This method is directed toward inhibiting initiation and progression of tumors. This method comprises the steps: i) expressing a PCP-2 polypeptide in a cell; ii) exposing said PCP-2-expressing cell to a test compound; iii) detecting PCP-2-mediated cytokine/growth factor secretion; and iv) comparing PCP-2-mediated cytokine/growth factor secretion with the test compound to that found in the absence of test compound. Preferred cells include those secrete cytokines or growth factors. Further preferred cells are those that secrete cytokines or growth factors processed by PCP-2 polypeptides, such as EGF or TGF-α. Expression of PCP-2 polypeptides may be accomplished in a cell by introducing a polynucleotide construct comprising polynucleotides encoding PCP-2 polypeptides to the cell by methods common to the art such as transfection or electroporation. Cytokine or growth factor secretion is detected by methods common to the art such as ELISA. Preferred test compounds include antibodies that bind PCP-2 polypeptides or fragments thereof.

In a further preferred embodiment of the invention, inhibitors of PCP-2 polypeptide activity are used to inhibit initiation and progression of tumors, such as those arising in the kidney, prostate, breast, skin, or endometrium. This method comprises contacting a PCP-2 polypeptide inhibiting amount of PCP-2 polypeptide inhibitor with a cell suspected of contributing to predisposition to a tumor phenotype or display of tumor phenotype as determined by methods common to the art including those discussed herein. Said inhibitor is contacted with a cell in a physiologically acceptable solution (e.g., a pH-buffered, isotonic solution) directly, topically, by injection, catheter, or other method as determined appropriate by one skilled in the art.

PCP-2 polypeptides are highly expressed in brain tissue and play a role in directional patterning, neuronal differentiation, and synapse formation. In a further embodiment of the invention, PCP-2 polypeptides are contacted with a neuronal cell to treat or prevent disorders involving directional patterning, neuronal differentiation, or synapse formation. This method is directed toward treatment of disorders such as Alzheimers, Parkinsons, and Huntingtons diseases, Tourette Syndrome, schizophrenia, mania, demntia, paranoia, obsessive compulsive disorder, panic disorder, psychoses, and learning or behavioral disorders. This method comprises the steps of introducing PCP-2 polypeptides to a neuronal cell suspected of predisposition to or displaying pathology of neural disorders or abnormal PCP-2 expression, as determined by methods common to the art including those discussed herein. As an example of this method, polypeptides or fragments thereof are introduced into a cell with a polynucleotide construct comprising polynucleotides encoding said polypeptides. Polynucleotide delivery is accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety. Such vectors may be targeted to cross the blood brain barrier by incorporation of a neural-specific targeting moiety, for example, a neuropeptide such as a dopamine derivative.

In a preferred embodiment of the invention, PCP-2 polypeptides or fragments thereof are used to produce antibodies according to methods well known in the art. The antibodies can be monoclonal or polyclonal. In a further preferred embodiment of the invention, antibodies that bind PCP-2 polypeptides or fragments thereof are used for purposes including identification of PCP-2 expressing cells and diagnosis of PCP-2-related disorders. This method comprises the steps of contacting said antibodies with a cell and detecting binding of said antibodies. For example, antibodies are contacted with sample cells in a biological fluid (e.g., blood, serum, cerebrospinal fluid, lymph, plasma, synovial fluid), biopsy, or histological medium. Detection of antibody binding is accomplished by methods common to the art such as visualization of a fluorescent antibody label. This method is applied, for example, to diagnose tumors such as those discussed above. In addition, this method may be applied to diagnosing tumor predisposition based on abnormal PCP-2 polypeptide expression. In addition, this method may be applied to diagnosing neuronal disorders, such as those discussed above, based on abnormal PCP-2 polypeptide expression. Furthermore, this method may be applied to identifying activated hematopoetic cells such as T cells.

Protein of SEQ ID NO:255 (106-037-1-0-E9-CS.cor)

The secreted Lactate DeHydrogenase (sLDH) protein of SEQ ID NO:255 is encoded by the cDNA of SEQ ID NO:14. The 381-amino-acid-long sLDH polypeptide displays a Prosite motif corresponding to lactate dehydrogenase from positions 71 to 380. In addition, the active site LGEHGDS, where H is the active site residue, is present in sLDH (positions 239 to 245). The protein of the invention contains an additional 50 N-terminal amino acids not found in other lactate dehydrogenase proteins. This N-terminal extension contains a signal peptide (cleavage site at amino acid 34) that allows the export of the protein to the extracellular domain or defines a particular subcellular localization.

sLDH is an enzyme with a biological activity of dehydrogenating lactic acid into pyruvic acid in conjunction with the hydrogen acceptor NAD+, and to producing lactic acid from pyruvic acid in the glycolytic pathway. sLDH catalyzes the conversion of urea and amino acid byproducts to pyruvic acid which can be detected by UV spectrometry. In a preferred embodiment of the invention, sLDH is used as a coupling enzyme to determine the activity of various amino-transferases, such as alanine aminotransferase (ALT). This method comprises the steps of contacting sLDH with an amino-transferase and detecting pyruvic acid concentration using, for example, UV spectrometry. Amino-transferases are enzymes which show high activity in the liver, heart, and kidney, and show remarkable increases in serum in association with various diseases. In a further embodiment of the invention, sLDH is used to measure the amount of pyruvic acid precursors such as urea in a given solution. This method comprises the step of contacting a sample solution with sLDH and detecting pyruvic acid concentration, e.g., by UV spectrometry.

In a preferred embodiment of the invention, sLDH polypeptides or fragments thereof are used to generate antibodies by methods known to those skilled in the art. Preferred antibodies are polyclonal or monoclonal. Further preferred antibodies specifically bind sLDH. Further preferred antibodies inhibit the biological activity of sLDH (inhibiting antibodies or inhAb). Furthermore, sLDH-specific antibodies may be coupled to a fluorescent or otherwise detectable molecular marker (detecting antibodies or dAb).

Levels of sLDH are elevated in the presence of myocardial. Levels of sLDH start to increase 24 to 48 hours after occlusion of the coronary artery, peak in 3 to 6 days, and return to normal in 8 to 14 days. In a preferred embodiment of the invention, antibodies specific for sLDH (dAb) are used to diagnose myocardial infarction. This method comprises the step of contacting a sLDH-specific antibody with a test biological sample, such as serum, detecting the level of sLDH by methods common to the art, and comparing the level of sLDH to a normalizing control sample. Preferred biological samples are obtained from individuals suspected of undergoing a recent myocardial infarction. This method is applied to obtaining a retrospective diagnosis of myocardial infarction.

Elevated sLDH levels have also been used as a prognostic indicator for cancers such as small cell lung carcinoma, leukemias, and hematologic malignancies and indicate a poor prognosis for such diseases. In a preferred embodiment of the invention, sLDH polypeptide-specific antibodies (dAb) are used for diagnosis and prognosis of cancers, for instance, hematologic malignancies, leukemias, and lung carcinomas. This method comprises the step of contacting dAb's with a test biological sample, such as cerebrospinal fluid or lung tissue, detecting the level of sLDH by methods common to the art (e.g., ELISA or immunohistochemistry), and comparing the level of sLDH to a normalizing control sample. In a further preferred embodiment of the invention, sLDH polypeptide-specific antibodies that inhibit the biological activity of sLDH (inhAb) are used to prevent cancers, for instance, hematologic malignancies and lung carcinomas. This method comprises the step of contacting inhAb's in a physiologically acceptable solution (e.g., a pH-balanced isotonic solution) with cells suspected of tumorigenic potential or pathology. Delivery of inhAb's may be accomplished by injection, inhalant, or other methods as determined appropriate by one skilled in the art.

Abnormally high sLDH activity decreases glucose metabolism and insulin secretion in islet beta cells, and it may therefore be directly responsible for insulin secretory defects in some forms of type 2 diabetes and obesity. In a preferred embodiment of the invention, sLDH-specific antibodies (dAb) are used to diagnose a predisposition for or pathology of insulin-related disorders such as type II diabetes and obesity. This method comprises the steps of: contacting dAb's with a test biological sample, such plasma, pancreatic juice or pancreatic tissue; detecting the level of sLDH by methods common to the art (e.g., ELISA or immunohistochemistry); and comparing the level of sLDH to a normalizing control sample. In a further preferred embodiment sLDH-specific antibodies that block sLDH biological function (inhAb) are used to prevent insulin-related disorders such as diabetes and obesity. This method comprises the step of contacting inhAb's with a pancreatic cell, preferably an islet beta cell. Delivery of inhAb's may be accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety. Such vectors may be further targeted to pancreatic tissue by embedding a pancreas-specific targeting moiety.

In another embodiment, the present protein can be used to identify ingredients for cosmetic formulations. Specifically, enhancers of lactate dehydrogenase can be included in cosmetic compositions to stimulate keratinocyte proliferation and collagen synthesis in cutaneous tissues. The inhibitors can be combined with other active ingredients such as pyruvic acid, acetic acid, acetoacetic acid, beta-hydroxybutyric acid, Krebs cycle pathway metabolites, aliphatic saturated or unsaturated fatty acids containing from 8 to 26 carbon atoms, omega-hydroxy acids containing from 22 to 34 carbon atoms, glutamic acid, glutamine, valine, alanine, leucine, and mixtures thereof (see, e.g., U.S. Pat. No. 5,853,742, the disclosure of which is hereby incorporated by reference in its entirety).

In another embodiment, the expression of the present protein is used as a marker for interleukin 1, e.g. IL-1 alpha, activity in cells or in a patient. Specifically, as it has been shown that sLDH expression is induced by IL-1 alpha, then the expression, or elevated expression, of the present protein can be used as a marker for the action of IL-1 on the cell. As IL-1 has been implicated in a number of physiological processes, including inflammation and more specifically in deleterious processes such as arthritis and autoimmune disorders, the present protein can serve as a marker for the presence of such disorders, or for a predisposition for the disorders.

Proteins of SEQ ID NOs:243, 253 (Internal Designation numbers 105-016-1-0-D3-CS and 105-095-2-0-G11-CS)

The 331-amino-acid-long Membrane Glycerophosphodiester Phosphodiesterase (MGP) protein of SEQ ID NO:243, encoded by the cDNA of SEQ ID NO:2, is highly homologous to the putative glycerophosphodiester phosphodiesterase (GP-PDE) MIR16 (Membrane Interacting protein of RGS16) protein (SPTREMBLNEW SPTREMBL SWISSPROT accession number AAF65234) encoded by the cDNA of GENPEPT GENPEPTNEW accession number AF212862. MGP is a likely splice variant of the MIR16 protein. Furthermore, a BLAST search with the amino acid sequence of SEQ ID NO:243 indicates that the protein of the invention is homologous to GP-PDEs of *E. coli* (SWISSPROT accession numbers P09394 and P10908) and *Haemophilus influenzae* (SWISSPROT accession number Q06282). The protein of SEQ ID NO:243 displays twomembrane-spanning segments(amino acids 7 to 27 and 258 to 278), a signal peptide (amino acids 19 to 24), and two N-glycosylation sites (asparagine residues at positions 168 and 198). The cDNA of SEQ ID NO:2 differs from the cDNA of GENPEPT GENPEPTNEW accession number AF212862 by its extended 5' and 3' termini, and from the cDNA of SEQ ID NO:12 by polymorphisms and alternate splicings. A preferred embodiment of the invention is directed toward the compositions of SEQ ID NO:2, SEQ ID NO:243, Clone 105-016-1-0-D3-CS, SEQ ID NO: 12, SEQ ID NO:253, and Clone105-095-2-0-G11-CS.

MGP polypeptides hydrolyze deacetylated phospholipid GPs, such as glycerophosphocholine (GPC) and glycerophosphoethanolamine, to sn-glycerol-3-phosphate (G3P) and the corresponding alcohols. MGP polypeptides interact with Regulator of G protein Signaling (RGS)16. The enzymatic activity of MGP and its interaction with RGS16 point to its important role in lipid metabolism and in G protein signaling.

Any of a number of in vitro assays can be used to detect SEQ ID NO: 243 or 253 protein activity, for example for in vitro screening of modulators of protein activity. Preferably cDNA encoding the protein of the invention is cloned in a prokaryotic expression vector, according to methods known to those skilled in the art. Briefly, the GP-PDE activity of the recombinant protein is analyzed by a coupled spectrophotometric assay as described by Larson and collaborators and adapted by Cameron and collaborators (Larson et al., J. Biol. Chem. 258:5426–5432 (1983); Cameron et al., Infect. Immun. 66:5763–5770 (1998)). Such enzymatic activity may be measured in vitro in the presence of modulating drugs.

In a preferred embodiment of the present invention, MGP polypeptides or fragments thereof are used to purify or specifically bind to human immunoglobin D. Several immunoglobin (Ig) binding bacterial cell wall proteins have been isolated and/or cloned during the last two decades. The best characterized of these are protein A of *Staphylococcus aureus* (which binds to human IgG subclasses 1, 2 and 4, IgG of several mammalians species, and in some instances human Ig of classes A, M, E), and protein G of group G beta-hemolytic streptococci (which binds to all human IgG subclasses and which also displays a wider binding spectrum for animal IgG than protein A). IgD binds to neither protein A nor protein G. Consequently, it is of great interest to identify new proteins capable of binding IgD, thereby allowing its separation and purification. In a further preferred embodiment of the invention, MGP polypeptides or fragments thereof are used in immunoprecipitation procedures with IgD, as are routinely performed with proteins A and G in the case of IgG. The binding and purification of IgD using MGP polypeptides or fragments thereof may be accomplished, for example, by covalently, non-covalently, or indirectly linking said MGP polypeptides to a solid or semi-solid matrix (such as gold, "Sephadex" particles, polymeric surfaces). Such a complex is very useful for IgDs immobilization and consecutive immunoprecipitation in batch.

In a preferred embodiment of the invention, MGP polypeptides or fragments thereof are used to hydrolyze deacylated phospholipids (GPs), such as glycerophosphocholine (GPC) and glycerophosphoethanolamine, to sn-glycerol-3-phosphate (G3P) and the corresponding alcohols. This method is directed toward modifying the structure and consequently the permeability of eukaryotic cell membranes by eliminating the hydrophilic moiety of lipid bilayer glycerophospholipids. Such modifications could improve the transfection efficiency of eukaryotic cells, in vitro or in vivo. This method comprises the step of introducing MGP polypeptides or fragments thereof into a cell. For example, MGP polypeptides may be introduced by delivering a polynucleotide construct comprising polynucleotides encoding MGP polypeptides to a cell using methods common to the art such as transfection or electroporation. In another embodiment of the invention, MGP polypeptides, fragments thereof, or polynucleotides encoding said polypeptides are used to diagnose, treat, and prevent disorders associated with excess G-protein signaling in the brain. As described above, MGP polypeptides interact physically with the RGS16 protein (Regulator of G protein Signaling 16). Receptors of many hormones use heterotrimeric G proteins for signal transduction after ligand binding. Among these receptors are metabotropic glutamate receptors (mGluRs). These receptors, which are expressed in the brain, like the protein of the invention, are a novel family of cloned G-protein-coupled receptors. Endogenous glutamate, by activating the mGluR1 receptor (and also NMDA and AMPA receptors), may contribute to the brain damage occurring acutely after epilepsy, cerebral ischemia or traumatic brain injury. It may also contribute to chronic neurodegeneration in such disorders as amyotrophic lateral sclerosis and Huntington's chorea (Meldrum, J. Nutr. 130(4S Suppl):1007S–1015S (2000)).

The invention thus relates to methods and compositions using cDNAs of SEQ ID NO:2 or 12 or part thereof, and proteins of SEQ ID NO:243 or 253 or part thereof, to diagnose, treat, or prevent disorders associated with excess glutamate signaling in the brain. Specifically, the level of activity or expression of the proteins can be correlated with the level of glutamate signaling, or with the glutamate-signaling associated brain damage involved in epilepsy, cerebral ischemia, traumatic brain damage, ALS, or Huntington's chorea, or with any other G-protein associated physiological process or disease or condition. For situations where the level of the expression or activity of the protein is positively correlated with such signaling or with the presence of a disease or condition, the signaling, disease or condition can be detected using any of a number of tools for detecting protein expression or activity, including northern blots, far-western blots and in situ hybridization experiments, where an elevated level of the protein, protein activity, or nucleic acid of the invention indicates the presence of the disease, condition, or signaling process. Further, such diseases or conditions can be treated or prevented, or such signaling pathways can be inhibited, using compounds that inhibit the expression or activity of the protein, such as antibodies, antisense molecules, ribozymes, dominant negative forms of the protein, or any heterologous molecule that inhibits protein activity or expression. Alternatively, where the expression or activity of the protein of the invention is negatively associated with the signaling pathway, disease or condition, a detection of a decreased level of expression or activity of the protein can be used to indicate the presence of the disease, condition, or pathway. Further, in such cases, the disease or condition can be treated or prevented, or the pathway be inhibited, using any compound that increases the activity or level of the protein, such as nucleic acids encoding the protein, the protein itself, or heterologous compounds that cause an increase in the level of protein expression or activity.

Protiens of SEQ ID NO:386 (Internal Designation 105-037-4-O-H12-CS)

The protein of SEQ ID NO:386, encoded by the cDNA of SEQ ID NO:145, is strongly expressed in the fetal brain and uterus. The 207-amino-acid-long protein of SEQ ID NO:386 displays pfam SPRY domains from positions 85 to 205.

SPRY domains have been found in a number of proteins involved in multiple cellular and developmental processes. For example, the Midline-1/FXY family of proteins has been shown to associate with microtubules, and has been implicated in human diseases, such as Opitz Syndrome, a congenital disorder characterized by multiple developmental abnormalities (see, e.g., Cainarca, et al., (1999) Hum Mol Genet 8(8):1387–96). In addition, the cytoplasmic Marenostrin/Pyrin protein has been demonstrated to be the cause of Familial Mediterranean fever, an autosomal recessive disorder characterized by fever and serositis (Nat Genet 1997 September;17(1):25–3 1). Other SPRY proteins include Sp1A, a serine protease from *Staphylococcus aureus*, and butyrophilin, a major milk protein. Another family of proteins known to contain the SPRY domain are the Ryanodine receptors (RyRs).

Ryanodine receptors play an important role in Ca2+ signaling in muscle and non muscle cells by releasing Ca2+ from intracellular stores. For example, these receptors are centrally important in excitation-contraction (e-c) coupling, which occurs at specialized regions where the sarcoplasmic reticulum (SR), containing the ryanodin receptors, and the plasma membrane/transverse-tubule system form junctions. RyRs are also thought to play some role in maintaining the structural integrity of the SR• T-tubule junctions. RyR is apparently unable to carry out the requisite functions associated with e-c coupling by itself, however, because it forms interactions with other macromolecules at the triad junction. For example, two small proteins, calmodulin and FKBP12, are believed to modulate RyR at the triad junction.

It is believed that mammalian tissues express three different RyR isoforms, comprising four 560-kDa (RyR polypeptide) and four 12-kDa (FK506 binding protein) subunits. It is believed that these large protein complexes conduct monovalent and divalent cations and are capable of multiple interactions with other molecules. The subunits of the protein complexes include small diffusible endogenous effector molecules including Ca2+, Mg2+, adenine nucleotides, sufhydryl modifying reagents (glutathione, NO, and NO adducts) and lipid intermediates, and proteins such as protein kinases and phosphatases, calmodulin, immunophilins (FK506 binding proteins), and in skeletal muscle the dihydropyridine receptor. The RyR from skeletal muscle is the major calcium release channel for that tissue, and the most intensively studied of the three genetic isoforms detected thus far in mammalian species. The other two RyR isoforms are often referred to as the 'heart' and 'brain' forms, but the actual cell and tissue distribution of the isoforms is complex.

Because of their multiple ligand interactions, ryanodin receptors constitute an important, potentially rich pharmacological target for controlling cellular functions. Ca2+ release channel activity is modulated by many endogenous effectors, including Ca2+, ATP, Mg2+, and calmodulin. In addition, many exogenous effectors, including caffeine, local anesthesics, and polyamines, also modify channel activity. For example, tetracaine, procaine, benzocaine, and lidocaine inhibit Ca2+ release from the SR. They appear to interact with a specific site(s) located on the RYR, affecting both ryanodin-binding and single channel activities (Shoshan-Barmatz et al. 1993; J. Membr. Biol.; 133; 171–181).

The importance of intracellular calcium as a second messenger in cellular signal transduction processes is well established. Alterations in intracellular Ca2+ homeostasis have profound effects on many cell functions, including secretion, contraction-relaxation, motility, metabolism, protein synthesis, modification and folding, gene expression, cell-cycle progression and apoptosis. A major source of cytoplasmic calcium is from intracellular storehouses located in the endoplasmic reticulum, or in muscle, within the sarcoplasmic reticulum (SR).

Given that cellular Ca2+ handling is an important factor in the control of neuronal metabolism and electrical activity, abnormalities of intracellular Ca2+ channels might be expected to contribute to some forms of epilepsy or to anoxic brain damage following an episode of cerebral ischemia. Cell loss is said to be a characteristic feature of degenerative brain disorders, including Alzheimer's disease. It is well established that neuronal cell death may be secondary to an abnormal elevation of cytoplasmic Ca2+, particulary that associated with activation of excitatory glutamate receptors (e.g., in epilepsy). This strongly suggests that the release of stored Ca2+ contributes to nerve cell damage and cell death in various circumstances.

It is believed that the protein of SEQ ID NO:386 is functionally related to other SPRY-containing proteins, such as the ryanodine receptors, Marenostrin/Pyrin, Sp1A, Midline-1/FXY, and butyrophilin. Accordingly, it is thus believed that the present protein is associated with the release of Ca2+ from intracellular Ca2+-storing organelles, like the endoplasmic reticulum and, in muscle, the sarcoplasmic reticulum (SR), as well as being involved in microtubule binding. Preferred polypeptides of the invention are any fragments of SEQ ID NO:386 having any of the biological activities described herein.

In one embodiment, the present protein and nucleic acids can be used to specifically detect cells of the fetal brain and uterus, as the protein is overexpressed in these tissues. For example, the protein of the invention or part thereof may be used to synthesize specific antibodies using any technique known to those skilled in the art. Such tissue-specific antibodies may then be used to identify tissues of unknown origin, such as in forensic samples, differentiated tumor tissue that has metastasized to foreign bodily sites, etc., or to differentiate different tissue types in a tissue cross-section using immunochemistry. The protein can also be used to specifically label microtubules in cells.

In another embodiment, the protein of the invention or part thereof may be used in regulating intracellular Ca2+ levels. As alterations in intracellular Ca2+ homeostasis have profound effects on many cell functions, including secretion, contraction-relaxation, motility, metabolism, protein synthesis, modification and folding, gene expression, cell-cycle progression and apoptosis, the ability to modulate intracellular Ca2+ levels provides a tool to alter any of these cellular functions, in vitro or in vivo. Such an ability has wide utility for a large number of applications, for example to manipulate the behavior (e.g. growth rate, secretion, survival, etc.) of cells grown in vitro, as well as to treat, prevent, or diagnose any of a number of diseases associated with altered Ca2+ signaling in vivo. The activity or expression of the protein of the invention can be modulated in any of a large number of ways, for example by administering to cells or to a patient the protein itself, a polynucleotide encoding the protein, antibodies, antisense sequences, dominant negative forms of the protein, compounds that alter the expression or activity of the protein, etc. The effect of any such agent on calcium flux in cells can be detected using standard methods, including by studying the permeation of Ca2+ release through endoplasmic reticulum (ER) and sarcoplasmic reticulum (SR) channels using tracers, light scattering and fluorescence quenching, and channel reconstitution in planar bilayer. In addition, targeted recombinant photoproteins can provide direct measurements of organellar Ca2+ (Montero et al.; 1995; EMBO J.; 14, 5467–5475).

The invention further relates to methods and compositions using the protein of the invention or part thereof to diagnose, prevent and/or treat several disorders in which the activity or recognition of ryanodin receptors, is impaired or excessive. These disorders include, but are not limited to, neurodegenerative diseases, cardiovascular disorders, severe myasthenia, malignant hyperthermia, epilepsy, and central core disease. For example, in patients with severe myasthenia, the level of anti-RyR antibodies has been directly related to the severity of the disease (Skeie et al., 1996: Eur. J. Neurol. 3; 136–140). There is also some evidence to suggest that RyR abnormalities are a primary cause of many types of cardiac disease. In addition, the protein of the invention can be used to diagnose other diseases associated with SPRY-protein dysfunction, such as Familial Mediterranean fever and Opitz syndrome. Finally, as SPRY containing proteins have been implicated in embryonic development (e.g. the Midline1 protein), the protein and nucleic acids of the invention can be used to detect developmental disorders, as the detection of a mutation in the gene encoding SEQ ID NO:386, or a detection of abnormal gene expression in a fetus, can be used to indicate the presence of a developmental abnormality. For example, as the protein of SEQ ID NO:386 is strongly expressed in the fetal brain, it is likely that the protein plays a role in the normal development of the brain in utero.

The present invention also relates to diagnostic assays for detecting altered levels of the protein of SEQ ID NO:386 in various tissues, as over-expression of the protein compared to normal control tissue samples can indicate the presence of certain disease conditions such as neurodegenerative disorders, cardiovascular disorders, svere myasthenia, malignant hyperthermia, epilepsy, and central core disease. Assays used to detect levels of the polypeptide of the present invention in a sample derived from a host are well-known to those of skill in the art and include radioimmunoassays competitive-binding assays, Western Blot analysis and ELISA assays.

Proteins SEQ ID NOs:283 and 286 (Internal Designations 174-38-1-0B6-CS LA and 174-41-1-0-A6-CS LA)

The protein of SEQ ID NO:283, encoded by the cDNA of SEQ ID NO:42, is overexpressed in salivary glands and to a lesser extent in bone marrow, and shows homology over the C-terminal length to the immunoglobin (Ig) protein superfamily, which is conserved among eukaryotes (including rabbit, rodents and human). In particular, the 468-amino-acid-long protein of the invention, which is similar in size to the constant chain of Ig related proteins, displays two pfam conserved immunoglobulin domains, from position 205 to 285 and from position 318 to 384, which are known to be involved in the basic structure of the light and heavy constant chains of immunoglobins. It is known (Orr H. T., Nature 282:266–270(1979)) that the Ig constant chain domains and a single extracellular domain in each type of MHC chain are closely related, sharing over one hundred amino-acids of homology. All members of the Ig related superfamily, including the MHC class I alpha chain and beta-2-microglobulin, as well as the MHC class II alpha and beta chains, display the prosite conserved characteristic pattern around the C-terminal cysteine ([FY]-x-C-x-[VA]-x-H). This cysteine is involved in the disulfide bond between the light and heavy chains, and is also found in the protein of the invention (position 380 to 386). The protein of the invention also exhibits an emotif Ig and Major Histocompatibility Complex protein signature from positions 319 to 336. In addition, the protein of the invention displays homology with tapasin (GeneBank No. AF009510), a chaperone-like protein closely associated with TAP-binding proteins, which is well conserved among eukaryotes (chicken, rodents and human). Tapasin has been shown to increase the efficiency of antigen processing and presentation by mediating the association of MHC complex proteins with TAP proteins to the endoplasmic reticulum and to the cell surface during immune response (for review see Abele, R, and Tampé, R., Bioch. et Biophysica Acta, 1999). In addition, the protein of the invention displays two transmembrane domains from positions 199 to 219 and from positions 406 to 426, a hydrophobic profile similar in amino acid position to the hydrophobic stretch of amino acids of human and mouse tapasin (Suling L., J. Biol. Chem., 274:8649–8654, 1999), and a secreted signal peptide from position 9 to 23. Both signatures are largely present in Ig related proteins such as secreted antibodies or antigen presenting proteins. The invention also encompasses a variant (SEQ ID NO:286) of SEQ ID NO:283, encoded by the cDNA of SEQ ID NO:45. The protein of SEQ ID No:286 is a 442-amino-acid-long protein with a C-terminal shorter end of 26 amino-acids compared to the protein of SEQ ID NO:283. The variant of SEQ ID NO:286, which results from a frameshift (position 1445 in SEQ ID NO:45) in the coding sequence that leads to a stop codon in the corresponding protein, displays characteristics identical to those described above in terms of motifs, Ig signatures, function, and potential uses.

The immunoglobulin (Ig) gene superfamily comprises a large number of cell surface glycoproteins that share sequence homology with the V and C domains of antibody heavy and light chains. These molecules function as receptors for antigens, immunoglobulins and cytokines as well as adhesion molecules, and play important roles in regulating the complex cell interactions that occur within the immune system (A. F. Williams et al., Annu. Rev. Immuno. 6:381–405, 1988, T. Hunkapiller et al., Adv. Immunol. 44:1–63, 1989; for a short review see also Prosite entry PS00290)

The introduction of an antigen into a host initiates a series of events culminating in an immune response. In addition, self-antigens can result in immunological tolerance or activation of an immune response against self-antigens. A major portion of the immune response is regulated by presentation of antigen by major histocompatibility complex molecules. MHC molecules bind to peptide fragments derived from antigens to form complexes that are recognized by T cell receptors on the surface of T cells, giving rise to the phenomenon of MHC-restricted T cell recognition. The ability of a host to react to a given antigen (responsiveness) is influenced by the spectrum of MHC molecules expressed by the host. Responsiveness correlates with the ability of specific peptide fragments to bind to particular MHC molecules.

There are two types of MHC molecules, class I and class II, each of which comrise two chains. In class I [2], the alpha chain is composed of three extracellular domains, a transmembrane region, and a cytoplasmic tail. The beta chain (beta-2-microglobulin) is composed of a single extracellular domain. In class II [3], both the alpha and the beta chains are composed of two extracellular domains, a transmembrane region and a cytoplasmic tail. MHC class I molecules are expressed on the surface of all cells, and MHC class II molecules are expressed on the surface of antigen presenting cells. MHC class II molecules bind to peptides derived from proteins made outside of an antigen presenting cell. In contrast, MHC class I molecules bind to peptides derived from proteins made inside a cell. In order to present peptide in the context of a class II molecule, an antigen presenting cell phagocytoses an antigen into an intracellular vesicle, in which the antigen is cleaved, bound to an MHC class II molecule, and then returned to the surface of the antigen presenting cell.

Major histocompatibility complex (MHC) class I molecules present antigenic peptides to CD8 T cells (Townsend, A. et al., Nature:340,443–448)). The peptides are generated in the cytosol and then translocated across the membrane of the endoplasmic reticulum by the transporter associated with antigen processing (TAP). TAP is a trimeric complex consisting of TAP1, TAP2, and tapasin (TAP-A). TAP1 and TAP2 are required for the peptide transport. Tapasin mediates the interaction of MHC class I HC-beta-2 microglobulin with TAP, and this interaction is essential for peptide loading onto MHC class I HC-beta-2-microglobulin (Suling et al., J. Biol. Chem., 274:8649–8654). T cell receptors (TCRs) are the second antigen recognition molecules, and recognize antigens that are bound by MHC molecules. Recognition of MHC complexed with peptide (MHC-peptide complex) by TCR can effect the activity of the T cell bearing the TCR. Thus, MHC-peptide complexes are important in the regulation of T cell activity and, thus, in regulating an immune response.

Human cytomegalovirus (HCMV) is a betaherpesvirus which causes clinically serious disease in immunocompromised and immunosuppressed adults, as well as in some infants infected in utero or perinatally (Alford, C. A., and W. J. Britt. 1990. Cytomegalovirus, p. 1981–2010. In D. M. Knipe and B. N. Fields (ed.), Virology, 2nd ed. Raven press, New York). In human cytomegalovirus (HCMV)-infected cells, expression of the cellular major histocompatibility complex (MHC) class I heavy chains is down-regulated, where down-regulation is defined as reduction in either synthesis, stability or surface expression of MHC class I heavy chains. A similar phenomenon has been reported for some other DNA viruses, including adenovirus, murine cytomegalovirus, and herpes simplex virus (Anderson, M., et al., Cell 43:215–222, 1985; Burgert and Kvist, Cell 41:987–997, 1985; Heise T. M., et al., J. Exp. Med. 187:1037–1046, 1998). In the adenovirus and herpes simplex virus systems, the product of a viral gene which is dispensable for replication in vitro is sufficient to cause down-regulation of MHC class I heavy chains (Anderson, M., et al., 1985, supra). The gene(s) involved in class I heavy chain down-regulation by murine cytomegalovirus have not yet been identified.

It is believed that the proteins of SEQ ID NOs: 283 and 286 are members of the immunoglobulin superfamily and, as such, play a role in the immune response, cellular proteolysis, cell proliferation and differentiation, pathogen recognition, apoptosis, and other processes associated with the Ig superfamily. In addition, the proteins of the invention are thought to be tightly linked to the antigen processing and presentation system in the context of peptide assembly and translocation of foreign peptides across endoplasmic reticulum and cell surface membranes as new chaperonin-like proteins associated with MHC I and TAP proteins. The weak homology (30%) with the TAP protein family is thought to indicate the specificity of the interactions of the proteins of the invention with MHC proteins and/or TAP-related proteins, as described by Suling et al., supra.

Preferred polypeptides of the invention are polypeptides comprising the amino acids of SEQ ID NO:283 from position 9 to 23, 199 to 219, 205 to 285, 318 to 384, 319 to 336, 380 to 386 and from 406 to 426. Other preferred polypeptides of the invention are fragments of SEQ ID NO:283 having any of the biological activities described herein.

In one embodiment, the invention relates to methods and compositions for using the protein of the invention or part thereof as a marker protein to selectively identify tissues, such as salivary glands and bone marrow tissues, which strongly express the protein of the invention. For example, the protein of the invention or part thereof may be used to synthesize specific antibodies using any techniques known to those skilled in the art including those described therein. Such tissue-specific antibodies may then be used to identify tissues of unknown origin, for example, forensic samples, differentiated tumor tissue that has metastasized to foreign bodily sites, or to differentiate different tissue types in a tissue cross-section using immunochemistry.

In another embodiment, the invention relates to methods for using the protein of the invention to visualize proteins and peptides involved in antigen recognition system within cells by virtue of their physical interaction with the proteins of the invention. For example, the protein may be used to detect the presence and/or the localization of MHC peptides and TAP-like proteins in a cell. The protein of the invention, and hence any interacting proteins, can be labeled using any of a number of methods, including by binding with specific antibodies or by creating a fusion protein comprising the protein of the invention as well as a readily detectable moiety, such as an epitope tag, biotin, or green fluorescent protein.

In another embodiment, polynucleotide or polypeptide sequences of the invention or part thereof may be used for the diagnosis of a disorder associated with a loss of regulation of the expression of the protein of the invention, preferably, but not limited to, deficiencies of the MHC protein system. Examples of such disorders include, but are not limited to, acquired immunodeficiency syndrome (AIDS), X-linked agammaglobinemia of Bruton, common variable immunodeficiency (CVI), DiGeorge's syndrome (thymic hypoplasia), thymic dysplasia, isolated IgA deficiency, severe combined immunodeficiency disease (SCID), immunodeficiency with thrombocytopenia and eczema (Wiskott-Aldrich syndrome), Chediak-Higashi syndrome, chronic granulomatous diseases, hereditary angioneurotic edema, immunodeficiency associated with Cushing's disease, Addison's disease, adult respiratory distress syndrome, allergies, ankylosing spondylitis, amyloidosis, anemia, asthma, atherosclerosis, autoimmune hemolytic anemia, autoimmune thyroiditis, bronchitis, cholecystitis, contact dermatitis, Crohn's disease, atopic dermatitis, dermatomyositis, diabetes mellitus, emphysema, episodic lymphopenia with lymphocytotoxins, erythroblastosis fetalis, erythema nodosum, atrophic gastritis, glomerulonephritis, Goodpasture's syndrome, gout, Graves' disease, Hashimoto's thyroiditis, hypereosinophilia, irritable bowel syndrome, multiple sclerosis, myasthenia gravis, myocardial or pericardial inflammation, osteoarthritis, osteoporosis, pancreatitis, polymyositis, psoriasis, Reiter's syndrome, rheumatoid arthritis, scleroderma, Sjogren's syndrome, systemic anaphylaxis, systemic lupus erythematosus, systemic sclerosis, thrombocytopenic purpura, ulcerative colitis, uveitis, Werner syndrome, complications of cancer, hemodialysis, and extracorporeal circulation, leukemias such as multiple myeloma, and lymphomas such as Hodgkin's disease; a cell proliferative disorder such as arteriosclerosis, atherosclerosis, bursitis, cirrhosis, hepatitis, mixed connective tissue disease (MCTD), myelofibrosis, paroxysmal nocturnal hemoglobinuria, polycythemia vera, psoriasis, primary thrombocythemia, and cancers including adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus; and an infection, such as infections by viral agents classified as adenovirus, arenavirus, bunyavirus, calicivirus, coronavirus, filovirus, hepadnavirus, herpesvirus, flavivirus, orthomyxovirus, parvovirus, papovavirus, paramyxovirus, picornavirus, poxvirus, reovirus, retrovirus, rhabdovirus, and togavirus; infections by bacterial agents classified as *pneumococcus, staphylococcus, streptococcus, bacillus, corynebacterium, clostridium, meningococcus, gonococcus, listeria, moraxella, kingella, haemophilus, legionella, bordetella,* gram-negative *enterobacterium* including *shigella, salmonella,* and *campylobacter, pseudomonas, vibrio, brucella, francisella, yersinia, bartonella, norcardium, actinomyces, mycobacterium, spirochaetale, rickettsia, chlamydia,* and *mycoplasma;* infections by fungal agents classified as *aspergillus, blastomyces, dermatophytes, cryptococcus, coccidioides, malasezzia, histoplasma,* and other fungal agents causing various mycoses; and infections by parasites classified as *plasmodium* or malaria-causing, parasitic *entamoeba, leishmania, trypanosoma, toxoplasma, pneumocystis carinii,* intestinal protozoa such as *giardia, trichomonas,* tissue nematodes such as *trichinella,* intestinal nematodes such as *ascaris,* lymphatic filarial nematodes, trematodes such as *schistosoma,* and cestrodes such as tapeworm. To assess abnormal expression of the present protein associated with any of these disorders, the level of the present polynucleotides or polypeptides can be detected in a biological sample or cell using any standard method, including Southern or northern analysis, dot blots, other membrane-based technologies, PCR technologies, dipstick, pin, ELISA assays, and in microarrays. Any of these methods may be used for the diagnosis of disorders characterized by an alteration of expression of SEQ ID NO:283 or 286, such as the disorders mentioned above, or in assays to monitor patients being treated with SEQ ID NO:283 or 286 or agonists, antagonists, or inhibitors of SEQ ID NO:283 or 286. Antibodies useful for diagnostic purposes may be prepared, e.g., in the same manner as that described in U.S. Pat. No. 6,135,941. Diagnostic assays for SEQ ID NO:283 or 286 include methods which utilize the antibody and a label to detect SEQ ID NO: 283 or 286 in human body fluids or in extracts of cells or tissues. The antibodies may be used with or without modification, and may be labeled by covalent or non-covalent attachment of a reporter molecule. A wide variety of reporter molecules, several of which are described above, are known in the art and may be used.

In another embodiment, the protein of SEQ ID NO:283 or 286 or a fragment or derivative thereof may be administered to a subject to diagnose, treat or prevent an immune disorder associated with decreased expression or activity of the protein of the invention. Such disorders can include, but are not limited to, acquired immunodeficiency syndrome (AIDS), X-linked agammaglobinemia of Bruton, common variable immunodeficiency (CVI), DiGeorge's syndrome (thymic hypoplasia), thymic dysplasia, isolated IgA deficiency, severe combined immunodeficiency disease (SCID), immunodeficiency with thrombocytopenia and eczema (Wiskott-Aldrich syndrome), Chediak-Higashi syndrome, chronic granulomatous diseases, hereditary angioneurotic edema, immunodeficiency associated with Cushing's disease, Addison's disease, adult respiratory distress syndrome, allergies, ankylosing spondylitis, amyloidosis, anemia, asthma, atherosclerosis, autoimmune hemolytic anemia, autoimmune thyroiditis, bronchitis, cholecystitis, contact dermatitis, Crohn's disease, atopic dermatitis, dermatomyositis, diabetes mellitus, emphysema, episodic lymphopenia with lymphocytotoxins, erythroblastosis fetalis, erythema nodosum, atrophic gastritis, glomerulonephritis, Goodpasture's syndrome, gout, Graves' disease, Hashimoto's thyroiditis, hypereosinophilia, irritable bowel syndrome, multiple sclerosis, myasthenia gravis, myocardial or pericardial inflammation, osteoarthritis, osteoporosis, pancreatitis, polymyositis, psoriasis, Reiter's syndrome, rheumatoid arthritis, scleroderma, Sjogren's syndrome, systemic anaphylaxis, systemic lupus erythematosus, systemic sclerosis, thrombocytopenic purpura, ulcerative colitis, uveitis, Werner syndrome, complications of cancer, hemodialysis, and extracorporeal circulation, leukemias such as multiple myeloma, and lymphomas such as Hodgkin's disease. In addition, such disorders associated with decreased protein expression or activity can be treated by administering to a patient polynucleotide sequences encoding the protein of the invention, e.g. inserted in an appropriate vector. In another example, a compound that increases either the activity of the protein of the invention or their expression can be administered to a patient to treat or prevent any of the diseases mentioned above.

In a further embodiment, an antagonist of the protein of the invention may be administered to a subject to treat or prevent an immune disorder associated with increased expression or activity of the protein of SEQ ID NO:283 or 286 including, but not limited to, auto-immune deseases or graft rejection. In one aspect, an antibody which specifically binds the protein of the invention may be used directly as an antagonist or indirectly as a targeting or delivery mechanism for bringing a pharmaceutical agent to cells or tissues which express the proteins of the invention, such as the salivary gland tissue or the bone marrow tissue. In addition, sense, antisense nucleotides, GSE, ribozymes, specific protein inhibitors such as antibodies or small coumpounds can be administered to inhibit the expression of the proteins of the invention.

In another embodiment, an antagonist of the protein of SEQ ID NO:283 may be administered to a subject to treat or prevent a cell proliferative disorder. Such disorders may include, but are not limited to, arteriosclerosis, atherosclerosis, bursitis, cirrhosis, hepatitis, mixed connective tissue disease (MCTD), myelofibrosis, paroxysmal nocturnal hemoglobinuria, polycythemia vera, psoriasis, primary thrombocythemia, and cancers including adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus. In one aspect, an antibody which specifically binds the protein of the invention may be used directly as an antagonist or indirectly as a targeting or delivery mechanism for bringing a pharmaceutical agent to cells or tissue which express the protein of the invention. In another example, sense, antisense nucleotides, GSE, or ribozymes designed from nucleotides of the invention can be administered to inhibit the expression of the protein of the invention.

Protiens of SEQ ID NO: 411 (Internal Designation 181-10-1-0-C9-CS)

The protein of SEQ ID NO: 411 encoded by the cDNA of SEQ ID NO: 170 is highly expressed in fetal liver. The protein of the invention is homologous to peripheral benzodiazepine receptor/isoquinoline binding protein (PBR/IBP) of human, bovine and murine origin (Genbank accession numbers M36035, M64520 and L17306 respectively). The 170-amino-acid protein of SEQ ID NO: 411 is similar in size and hydropathicity to known peripheral PBR/IBP benzodiazepine receptors/isoquinoline binding proteins. Like the known peripheral benzodiazepine receptors/isoquinoline binding proteins, the protein of the subject invention has about five potential transmembrane domains at positions 3–23, 45–65, 82–102, 105–125 and 130–150. Moreover, the protein of the invention displays a stretch of 11 amino acids (starting with V144 and ending with R154) that corresponds to a recently identified putative cholesterol recognition/interaction amino acid consensus pattern (-L/V-(X)(1–5)-Y-(X)(1–5)-R/K-) [See Li et al, *Endocrinology* 1998 December; 139 (12): 4991–7]. A preferred embodiment of the invention includes the composition of a preferred polypeptide of the invention comprises the amino acids of SEQ ID NO: 411. Other preferred polypeptides of the invention include biologically active fragments of SEQ ID NO: 411. Biologically active fragments of the protein of SEQ ID NO: 411 have any of the biological activities described herein. A preferred embodiment of the invention is directed toward the compositions of SEQ ID NO:170, SEQ ID NO:411, and Clone 181-10-1-0-C9-CS.

The protein of SEQ ID NO:411 represents the novel peripheral-type benzodiazepine receptor, HPBR. As such, it is serves a channel function that mediates cholesterol movement across membranes, play a role in steroidogenesis, cell growth and differentiation, chemotaxis, mitochondrial physiology, protection against apoptosis, porphyrin and heme biosynthesis, immune response, anion transport and GABAergic regulation of CNS.

HPBR is associated with a multimeric complex composed of the 18-kDa isoquinoline binding protein and the 34-kDa pore-forming voltage dependent anion channel protein, preferentially located on the outer/inner mitochondrial membrane contact sites. Drug ligands of HPBR, upon binding to the receptor, simulate steroid synthesis in steroidogenic cells in vitro Furthermore, HPBR ligands, drug ligands, or the endogenous PBR ligand (the polypeptide diazepam-binding inhibitor (DBI)) stimulate pregnenolone formation by increasing the rate of cholesterol transfer from the outer to the inner mitochondrial membrane. In a preferred embodiment of the invention, HPBR polypeptides or a polynucleotide construct comprising polynucleotides encoding said polypeptide are used to transport cholesterol into cells. Diseases associated with cholesterol transport deficiencies include lipoidal adrenal hyperplasia, and diseases where there is a requirement for increased production of compounds requiring cholesterol such as myelin and myelination, such as multiple sclerosis, Alzheimer's disease, spinal chord injury, and brain development neuropathy. The methods of treating such disorders may be practiced by introducing agonists which stimulate the expression or the activity of HPBR polypeptides. Further methods include introduction of a polynucleotide construct comprising polynucleotides encoding HPBR polypeptide into a cell. These methods are discussed herein.

In addition to its role in mediating cholesterol movement across membranes, HPBR is implicated in several other physiological functions, including cell growth and differentiation, chemotaxis, mitochondrial physiology, porphyrin and heme biosynthesis, immune response, anion transport and GABAergic regulation of CNS HPBR is associated with stress and anxiety disorders. HPBR plays a role in the regulation of several stress systems such as the HPA axis, the sympathetic nervous system, the renin-angiotensin axis, and the neuroendocrine axis. In these systems, acute stress leads to increases in HPBR density, whereas chronic stress typically leads to decreases in HPBR density. Furthermore, in Generalized Anxiety Disorder (GAD), Panic Disorder (PD), Generalized Social Phobia (GSP), and Post-Traumatic Stress Disorders (PTSD), HPBR density is typically decreased in platelets.In the brain, glial-associated HPBR is increased in neurodegenerative disorders, after neurotoxic and traumatic-ischemic brain damage, and in autopsied brain tissue from PSE patients (Portal-Systemic Encephalopathy). HPBR is decreased in postmortems of chronic schizophrenics. Therefore, HPBR contributes to characteristic pathologies of the central nervous system (CNS). In a preferred embodiment of the invention, agents to detect HPBR polypeptides or polynucleotides encoding said polypeptides are used to diagnose abnormal HPBR expression and related disorders. This method comprises the step of contacting said agents with biological samples and of detecting polypeptides and polynucleotides are discussed herein. In a preferred embodiment of the invention, HPBR polypeptides, a polynucleotide construct comprising polynucleotides encoding said polypeptide, or agonists of HPBR activity are used to treat diseases or disorders associated with decreased levels of the protein of the HPBR including, and not limited to, schizophrenia, chronic stress, GAD, PD, GSP and PTSD. This method comprises the step of contacting HPBR polypeptides, a polynucleotide construct comprising polynucleotides encoding said polypeptide, or agonists of HPBR activity with cells of the CNS.

HPBR polypeptides may be delivered by a polynucleotide construct comprising polynucleotides encoding said polypeptides. Polynucleotide delivery is accomplished by methods that include but are not limited to: lipid vesicle delivery (including micelles, viral envelope components, lipsomes, and modified versions of these) as discussed in U.S. Pat. Nos. 6,110,490, 5,019,369, and P.C.T. 9704748, which disclosures are hereby incorporated by reference in their entireties and viral transduction (including attenuated lentiviral and adenoviral systems) as discussed in U.S. Pat. No. 6,204,060, which disclosure is hereby incorporated by reference in its entirety. Agonists may be delivered directly to the blood stream in a physiologically acceptable solution as these are able to pass the blood-brain barrier (U.S. Pat. No. 4,902,505, the disclosure of which is incorporated herein in its entirety).

HPBR has been implicated in the regulation of tumor cell proliferation. Furthermore, HPBR agonists are potent antiapoptotic compounds. The invasiveness and metastatic ability of human breast tumor cells is proportional to the level of HPBR expressed.

One aspect of the subject invention provides compositions and methods using the protein of the invention, or biologically active fragments thereof, for the development, identification, and/or selection of agents capable of modulating the expression or activity of the protein of the invention.

Agents which modulate the activity of the HPBR of the subject invention include, but are not limited to, antisense oligonucleotides, ribozymes, drugs, and antibodies. These agents may be made and used according to methods well known in the art. Also, the protein of the invention, or biologically active fragments thereof, may be used in screening assays for therapeutic compounds. A variety of drug screening techniques may be employed. In this aspect of the invention, the protein or biologically active fragment thereof, may be free in solution, affixed to a solid support, recombinantly expressed on, or chemically attached to, a cell surface, or located intracellularly. The formation of binding complexes, between the protein of the invention, or biologically active fragments thereof, and the compound being tested, may then be measured.

In one embodiment, the subject method utilizes eukaryotic or prokaryotic host cells which are stably transformed with recombinant nucleic acids expressing the HPBR polypeptide or biologically active fragments thereof. The transformed cells may be viable or fixed. Drugs or compounds which are candidates for the modulation of the HPBR, or biologically active fragments thereof, are screened against such transformed cells in binding assays well known to those skilled in the art. Alternatively, assays such as those taught in Geysen H. N., WO Application 84/03564, published on Sep. 13, 1984, and incorporated herein by reference in its entirety, may be used to screen for peptide compounds which demonstrate binding affinity for, or the ability to modulate, the HPBR, or biologically active fragments thereof. In another embodiment, competitive drug screening assays using neutralizing antibodies specifically compete with a test compound for binding to the PBR/IBP protein of the invention, or biologically active fragments thereof.

Another embodiment of the subject invention provides compositions and methods of selectively modulating the expression or activity of the protein of the invention. Modulation of the HPBR would allow for the successful treatment and/or management of diseases or biochemical abnormalities associated with HPBR. Antagonists, able to reduce or inhibit the expression or the activity of the protein of the invention, would be useful in the treatment of diseases associated with elevated levels of the HPBR, increased cell proliferation, or increased cholesterol transport. Thus, the subject invention provides methods for treating a variety of diseases or disorders, including, but not limited to, cancers, especially liver cancer, and portal-systemic encephalopathy.

In one embodiment, methods of increasing the levels of HPBR in tissues or cell types may be practiced by utilizing polynucleotides encoding the protein of the subject invention, or biologically active fragments thereof, to introduce biologically active polypeptide into targeted cell types. Polynucleotide vectors useful in such methods are known to those skilled in the art as are methods of introducing such nucleic acids into target tissues.

Agents which stimulate or inhibit the activity of the protein of the invention include but are not limited to agonist and antagonist drugs respectively. These drugs can be obtained using any of a variety of drug screening techniques as discussed above.

Antagonists of the HPBR encoded by SEQ ID NO:170 include agents which decrease the levels of expressed mRNA encoding the protein of SEQ ID NO:411. These include, but are not limited to, RNAi, one or more ribozymes capable of digesting the protein of the invention mRNA, or antisense oligonucleotides capable of hybridizing to mRNA encoding HPBR of SEQ ID NO: 411 Antisense oligonucleotides can be administrated as DNA, as DNA entrapped in proteoliposomes containing viral envelope receptor proteins [Kanoda, Y. et al. (1989) *Science* 243: 375] or as part of a vector which can be expressed in the target cell and provide antisense DNA or RNA. Vectors which are expressed in particular cell types are known in the art. Alternatively, the DNA can be injected along with a carrier. A carrier can be a protein such as a cytokine, for example interleukin 2, or polylysine-glycoprotein carriers. Carrier proteins, vectors, and methods of making and using polylysine carrier systems are known in the art. Alternatively, nucleic acid encoding antisense molecules may be coated onto gold beads and introduced into the skin with, for example, a gene gun [Ulmer, J. B. et al. (1993) *Science* 259:1745].

Antibodies, or other polypeptides, capable of reducing or inhibiting the activity of HPBR may be provided as in isolated and substantially purified form. Alternatively, antibodies or other polypeptides capable of inhibiting or reducing the activity of HPBR polypeptides, may be recombinantly expressed in the target cell to provide a modulating effect. In addition, compounds which inhibit or reduce the activity of the HPBR polypeptides of the subject invention may be incorporated into biodegradable polymers being implanted in the vicinity of where drug delivery is desired. For example, biodegradable polymers may be implanted at the site of a tumor or, alternatively, biodegradable polymers containing antagonists/agonists may be implanted to slowly release the compounds systemically. Biodegradable polymers, and their use, are known to those of skill in the art (see, for example, Brem et al. (1991) *J. Neurosurg.* 74:441–446).

In another embodiment, the invention provides methods and compositions for detecting the level of expression of the mRNA of the protein of the invention. Quantification of mRNA levels of the PBR/IBP protein of the invention may be useful for the diagnosis or prognosis of diseases associated with an altered expression of the protein of the invention. Assays for the detection and quantification of the mRNA of the protein of the invention are well known in the art (see, for example, Maniatis, Fitsch and Sambrook, Molecular Cloning; A Laboratory Manual (1982), or Current Protocols in Molecular Biology, Ausubel, F. M. et al. (Eds), Wiley & Sons, Inc.).

Polynucleotide probes or primers for the detection of the mRNA of the protein of SEQ ID NO: 411 can be designed from the cDNA of SEQ ID NO: 170. Methods for designing probes and primers are known in the art. In another embodiment, the subject invention provides diagnostic kits for the detection of the mRNA of the protein of the invention in cells. The kit comprises a package having one or more containers of oligonucleotide primers for detection of the protein of the invention in PCR assays or one or more containers of polynucleotide probes for the detection of the mRNA of the protein of the invention by in situ hybridization or Northern analysis. Kits may, optionally, include containers of various reagents used in various hybridization assays. The kit may also, optionally, contain one or more of the following items: polymerization enzymes, buffers, instructions, controls, or detection labels. Kits may also, optionally, include containers of reagents mixed together in suitable proportions for performing the hybridization assay methods in accordance with the invention. Reagent containers preferably contain reagents in unit quantities that obviate measuring steps when performing the subject methods.

In another embodiment, the invention relates to methods and compositions for detecting and quantifying the level of the protein of the invention present in a particular biological sample. These methods are useful for the diagnosis or prognosis of diseases associated with altered levels of HPBR polypeptides. Diagnostic assays to detect the protein of the invention may comprise a biopsy, in situ assay of cells from organ or tissue sections, or an aspirate of cells from a tumor or normal tissue. In addition, assays may be conducted upon cellular extracts from organs, tissues, cells, urine, or serum or blood or any other body fluid or extract.

Assays for the quantification of the HBPR of SEQ ID NO: 411 may be performed according to methods well known in the art. Typically, these assays comprise contacting the sample with a ligand of the protein of the invention or an antibody (polyclonal or monoclonal) which recognizes the protein of the invention or a fragment thereof, and detecting the complex formed between the protein of the invention present in the sample and the ligand or antibody. Fragments of the ligands and antibodies may also be used in the binding assays, provided these fragments are capable of specifically interacting with the BRP/IRP of the subject invention. Further, the ligands and antibodies which bind to the BRP/IRP of the invention may be labeled according to methods known in the art. Labels which are useful in the subject invention include, but are not limited to, enzymes labels, radioisotopic labels, paramagnetic labels, and chemiluminescent labels. Typical techniques are described by Kennedy, J. H., et al. (1976) *Clin. Chim. Acta* 70:1–31; and Schurs, A. H. et al. (1977) *Clin. Chim. Acta* 81: 1–40.

The subject invention also provides methods and compositions for the identification of metastatic tumor masses. In this aspect of the invention, the polypeptides and antibodies which bind the polypeptides of the invention may be used as a marker for the identification of the metastatic tumor mass. Metastatic tumors which originated from the liver may overexpress HPBR of SEQ ID NO: 411, whereas newly forming tumors, or those originating from other tissues are not expected to bear HPBR of SEQ ID NO: 411.

Protiens of SEQ ID NO: 397 (Internal Designation 160-28-4-0-C4-CS).

The protein of SEQ ID NO: 397, encoded by the cDNA of SEQ ID NO: 156 (clone 160-28-4-0-C4-CS), exhibits homology to the ADP-ribosylation factors (ARF) family of proteins. The ARF family includes ADP-ribosylation factors (ARFs) and ARF-like proteins (ARLs); the ARF family of proteins is one family of the Ras superfamily. Proteins belonging to the Ras superfamily have molecular weights of 18–30 kDa and function in a variety of cellular processes including, but not limited to, signaling, growth, immunity, and protein transport.

ARFs are monomeric GTP-binding proteins, related structurally to both G protein alpha-subunits and Ras proteins. ARF family members share more than 60% sequence identity, appear to be ubiquitous in eukaryotes, and are evolutionarily highly conserved throughout. Immunologically, they have been localized to the Golgi apparatus of several types of cells (Stearns et al. Proc. Natl. Acad. Sci. (USA) 87:1238–1242 (1990)). ARF proteins enhance the ADP-ribosyltransferase activity of cholera toxin as an allosteric activator (Noda et al. Biochim. Biophys. Acta 1034: 195–199 (1990)). ARFs have also been shown to act as regulatory molecules, or "switches", for linking two processes (e.g., the process of vesicle fission from a donor compartment and fusion with an acceptor compartment (Rothman, J. E. and Wieland, F. T. Science 272: 227–234 (1996)). ARF family members fall into three classes, classes I–III, according to their size and sequence homology. Class I comprises ARF1, ARF2, and ARF3; Class II comprises ARF4 and ARF5; and Class III comprises ARF6.

The classes occupy different subcellular locations and have been implicated in different transport pathways. Class I ARFs localize to the Golgi where they are involved in the regulation of ER-Golgi and intra-Golgi transport. Class I ARFs are also involved in the recruitment of cytosolic coat proteins to Golgi membranes during the formation of transport vesicles. Class III (e.g., ARF6) localizes to a tubulovesicular compartment, secretory granules, and the plasma membrane, where it is involved in regulated secretion and recycling. Class II ARFs appear to be cytosolic, but their role has not been elucidated. (Radhakrishna, H. and Donaldson, J. G. J. Cell Biol. 139: 49–61(1997)).

ARF function, in general, is regulated by a GDP-GTP cycle. For example, ARF1 is cytosolic in the GDP bound state, but is associated with membranes when in the GTP bound state. A guanine nucleotide exchange factor (GEF) in the donor compartment recruits ARF1 to the membrane. At the membrane, GTP-ARF1 recruits coat proteins, which assemble together into spherical coats, budding off vesicles in the process. After budding, hydrolysis of bound GTP causes ARF1 to dissociate from the membrane. ARF1 dissociation causes the coat to become unstable and dissociate as well. (Rothman, supra.)

Members of the ARF multigene family, when expressed as recombinant proteins in *E. coli*, display different phospholipid and detergent requirements (Price, et al. J. Biol. Chem. 267: 17766–17772 (1992)). Some lipids and/or detergents, e.g., SDS, cardiolipin, dimyristoylphosphatidylcholine (DMPC)/cholate, enhance ARF activities (Bobak, et al. Biochemistry 29:855–861 (1990); Noda, et al. Biochim. Biophys. Acta 1034: 195–199 (1990); Tsai, et al. J. Biol. Chem. 263:1768–1772 (1988)). ARFs also activate phospholipase D (PLD), a membrane-bound enzyme implicated as an effector of several growth factors (Boman, A. L. and Kahn, R. A. Trends Biochem. Sci. 20: 147–150 (1995). PLD1 has been shown to be activated by a variety of G-protein regulators, for example, PKC (protein kinase C) and ADP-ribosylation factor (ARF). PKC and ARFs may regulate G-proteins either individually or together in a synergistic manner. Recently the role of ARFs in microtubules formation has also been demonstrated. ADP-ribosylation of tubulin almost completely blocked self-assembly of this protein in brain (Terashima M. et a; J. Nutr Sci Vitaminol 45: 393–400 (1999)).

In general, differences in the various ARF sequences are concentrated in the amino-terminal regions and the carboxyl portions of the proteins. Only three of 17 amino acids in the amino termini have shown to be identical among ARFs, and four amino acids in this region of ARFs 1–5 are missing in ARF 6 (Tsuchiya, et al. J. Biol. Chem. 266: 2772–2777 (1991)). It was reported (Kahn, et al. J. Biol. Chem. 267:13039–13046 (1992)) that the amino-terminal regions of ARF proteins form an alpha-helix and that this domain is required for membrane targeting, interaction with lipid, and ARF activity.

Schliefer et al., (J. Biol. Chem. 257: 20–23 (1991)) have described a protein distinctly larger than ARF that possessed ARF-like activity. ARF-like proteins, or ARLs, have been found in different species. Some of ARLs appear to lack ADP-ribosyltransferase-enhancing activity; ARLs may differ in GTP-binding requirements and GTPase activity as compared to various ARF isoforms. For example, ARP, a mammalian ARL, is 33–39% identical to members of the ARF family; ARP, however, differs from other ARF family proteins by virtue of its ability to hydrolyze bound GTP in the absence of other proteins. ARP protein, unlike ARFs, is typically associated with plasma membrane instead of the cytosol (Schurmann, A. J. Biol. Chem. 270, 30657–30663 (1995)).

ARF family members have been implicated in several disease processes, such as Lowe's syndrome, an X-linked disorder characterized by congenital cataracts, renal tubular dysfunction and neurological deficits. These disorders may be due to an inability to recruit ARF to the Golgi membrane (Suchy, S. F. et al. Hum. Mol. Genet. 4: 2245–2250 (1995), Londono I. et al. Kidney Int. 55: 1407–1416 (1999)). It has also been suggested that regulation of ARF is also involved in cystic fibrosis, Dent's disease, diabetes, and autosomal dominant polycystic kidney disease (Marshansky, V., et al. Electrophoresis 18: 2661–2676 (1997)).

The new human ARF-related protein of SEQ ID NO:397, encoded by clone 160-28-4-0-C4-CS in one embodiment, and the related polynucleotides, provide new compositions which are useful in the diagnosis, treatment, and prevention of secretory, exocytosis, endocytosis and another "sorting disorders."

The subject invention provides a polypeptide comprising the amino acid sequence of SEQ ID NO: 397 or clone 160-28-4-0-C4-CS, or biologically active fragments thereof. The intact protein of interest is 173 amino acids in length, has an ARF family amino acid motif (Pfam), and has ATP/GTP-binding site motif A P-loop (PS00017). The protein of SEQ ID NO: 397 or clone 160-28-4-0-C4-CS also has chemical and structural similarity with human ARL1 (P40616), ARD-1 (R66033) and ARF6 (GI 178989) (31%, 31% and 27% identity, respectively). The amino acid length of SEQ ID NO: 397 is similar to those of the aforementioned ARFs Biologically active fragments of SEQ ID NO: 397 have one or more of the biological activities typically associated the full length protein. In one embodiment, the protein is encoded by clone 160-28-4-0-C4-CS The invention also provides variants of the protein of SEQ ID NO: 397 or clone 160-28-4-0-C4-CS. The variants have at least about 80%, more preferably at least about 90%, and most preferably at least about 95% amino acid sequence identity to the amino acid sequence of SEQ ID NO: 397 or clone 160-28-4-0-C4-CS. Variants according to the subject invention have at least one functional and/or structural characteristic of ARFs. The invention also provides biologically active fragments of the variant proteins.

The invention includes those polynucleotides encoding the protein of SEQ ID NO: 397 or clone 160-28-4-0-C4-CS, variants of SEQ ID NO: 397 or clone 160-28-4-0-C4-CS, and biologically active fragments of both the protein of SEQ ID NO: 397 or clone 160-28-4-0-C4-CS and variants thereof. As is apparent to those skilled in the art, a variety of different DNA sequences can encode the amino acid sequence of the proteins, variants, and biologically active fragments of said proteins and variants. It is well within the skill of a person trained in the art to create these alternative DNA sequences encoding proteins having the same, or essentially the same, amino acid sequence. These variant DNA sequences are also within the scope of the subject invention. As used herein, reference to "essentially the same" sequence refers to sequences that have amino acid substitutions, deletions, additions, or insertions that do not materially affect biological activity.

The subject invention provides method of treating cytoskeletal, secretory, and inflammatory disorders/conditions comprising the administration of therapeutically effective amounts of a composition comprising the protein of SEQ ID NO: 397 or clone 160-28-4-0-C4-CS. These methods can also be practiced using variants of SEQ ID NO: 397 or clone 160-28-4-0-C4-CS, or biologically active fragments of either SEQ ID NO: 397 or clone 160-28-4-0-C4-CS, or variants of SEQ ID NO: 397 or clone 160-28-4-0-C4-CS. Disorders/conditions which can be treated by the subject invention include, but are not limited to, prostate cancer, brain and another tumors, Lowe's syndrome, glomerulonephritis, chronic glomerulonephritis, tubulointerstitial nephritis, inherited X-linked nephrogenic diabetes insipidus, autosomal dominant polycystic kidney disease (ADPKD), herpes gestationis, dermatitis herpetiformis, lupus erythematosus, Crohn's disease, irritable bowel syndrome and Addison's disease; secretory/endocytotic disorders such as cystic fibrosis, glucose-galactose malabsorption syndrome, hypercholesterolemia, hyper- and hypoglycemia, Grave's disease, goiter, and Cushing's disease; conditions associated with abnormal vesicle trafficking, including acquired immunodeficiency syndrome (AIDS); allergies including hay fever, asthma, and urticaria (hives); autoimmune hemolytic anemia; multiple sclerosis; myasthenia gravis; rheumatoid and osteoarthritis; Chediak-Higashi and Sjogren's syndromes; toxic shock syndrome; traumatic tissue damage; viral, bacterial, fungal, helminthic, and protozoal infections.

In another embodiment, a vector capable of expressing the protein of SEQ ID NO: 397 or clone 160-28-4-0-C4-CS, or biologically active fragments thereof, can be administered to a subject to treat or prevent disorders including, but not limited to, those described above. Alternatively, the vector can encode a variant, or biologically active fragment of the variant protein. Multiple vectors encoding any combination of SEQ ID NO: 397 or clone 160-28-4-0-C4-CS, variants, and/or biologically active fragments of SEQ ID NO: 397 or clone 160-28-4-0-C4-CS and/or variants can be administered to a subject.

In a further embodiment, a pharmaceutical composition comprising a substantially purified protein of SEQ ID NO: 397 or clone 160-28-4-0-C4-CS (and/or biologically active fragments thereof), in conjunction with a suitable pharmaceutical carrier, can be administered to a subject to treat or prevent the above mentioned disorders. Alternatively, a pharmaceutical composition comprising a substantially purified variant protein of SEQ ID NO: 397 or clone 160-28-4-0-C4-CS (and/or biologically active fragments thereof), in conjunction with a suitable pharmaceutical carrier, can be administered in the aforementioned therapeutic regimens. As would be apparent to the skilled artisan, any therapeutically effective combination of the protein encoded by SEQ ID NO: 397 or clone 160-28-4-0-C4-CS (and/or biologically active fragments thereof) and variants of SEQ ID NO:397 or clone 160-28-4-0-C4-CS (and/or biologically active fragments thereof), in conjunction with a suitable pharmaceutical carrier can be used in the aforementioned therapeutic regimens.

ARFs are known to be involved in regulated transport of vesicles. Therefore, in another embodiment, the protein of SEQ ID No: 397 or clone 160-28-4-0-C4-CS, variants, and/or biologically active fragments of said proteins and/or variants can be used as a component of drug delivery vehicles such as colloids or liposomes. The protein of SEQ ID NO: 397 or clone 160-28-4-0-C4-CS, variants, and/or biologically active fragments of said proteins and/or variants can be incorporated into the lipid membranes of liposomes and can serve as specific targeting agents. The methods of design of such drug delivery systems is known by those skilled in the art and can be practiced according to conventional pharmaceutical principles (Smith H. J. Introduction to the principles of drug design and action, $3^{rd}$ ed. (1998); Chien Y. W. Novel Drug Delivery systems, $2^{nd}$ ed. (1992); Storm G. et al J.Liposome Res. 4: 641–666 (1994); and Crommelin D. J. A. et al. Adv. Drug Delivery Rev. 17: 49–60 (1995)).

In another embodiment of the invention, the polynucleotides encoding the protein of SEQ ID NO: 397 or clone 160-28-4-0-C4-CS can be used for therapeutic purposes. Polynucleotides encoding fragments of the protein of SEQ ID NO:397 or clone 160-28-4-0-C4-CS can also be used in therapeutic regiments. In one aspect, the complement of the polynucleotide encoding the protein of SEQ ID NO.: 397 or clone 160-28-4-0-C4-CS can be used in situations in which it would be desirable to block the transcription of the mRNA. Modifications of gene expression can be obtained by designing complementary sequences or antisense molecules (DNA, RNA, or PNA) to the control, 5', or regulatory regions of the gene encoding the protein of interest. Such technology is now well known in the art, and sense or antisense oligonucleotides or larger fragments can be designed from various locations along the coding or control regions of sequences encoding the protein of interest. Methods of treatment utilizing antisense technology are also well known to those skilled in the art.

Another embodiment of the invention provides methods of assessing PLD modulation by using ARF properties of the protein of interest.

In another embodiment, antibodies which specifically bind the protein of SEQ ID NO: 397 or clone 160-28-4-0-C4-CS can be used for the diagnosis of disorders characterized by expression of the protein, or in assays to monitor patients being treated with the protein of interest. Methods of making both polyclonal and monoclonal antibodies are well-known in the art. Diagnostic assays which can be used in this aspect of the invention include, and are not limited to, ELISAs, RIAs, and FACS, and are well known in the art. These assays also provide a basis for diagnosing or identifying altered or abnormal levels of SEQ ID NO:397 or the polypeptides encoded by the human cDNA of clone 160-28-4-0-C4-CS expression as compared to normal individuals. These screening methods are, likewise, well known to the skilled artisan.

In another embodiment of the invention, the protein of interest, its catalytic or immunogenic fragments, or oligopeptides thereof can be used for screening libraries of compounds in any of a variety of drug screening techniques. The fragment employed in such screening can be free in solution, affixed to a solid support, recombinantly expressed on, or chemically attached to, a cell surface, or located intracellularly. The formation of binding complexes between the protein of interest and the agent being tested can be measured by methods well known to those skilled in the art. Another technique for drug screening provides for high throughput screening of compounds having suitable binding affinity to the protein of interest. (See, e.g., Geysen, et al. (1984) PCT application WO84/03564.)

In another embodiment of the invention, the polynucleotides encoding the protein of interest can be used for diagnostic purposes. The polynucleotides can be used to detect and quantify gene expression in biopsied tissues in which expression of the protein of interest can be correlated with a disease or condition. Such diagnostic assays are well known in the art and can be used to monitor regulation of the protein of interest levels during therapeutic intervention and/or to determine absence, presence, and excess expression of the protein of interest. Examples of such conditions and disorders have been provided supra. The polynucleotide sequences encoding the protein of interest can be used, for example, in Southern or Northern analyses, dot blot, or other membrane-based technologies; in PCR technologies; in dipstick, pin, and ELISA assays; and in microarrays utilizing fluids or tissues from patients to detect altered expression of the protein of SEQ ID NO:397 or clone 160-28-4-0-C4-CS. Such qualitative or quantitative methods are well known in the art.

In further embodiments, oligonucleotides or longer fragments derived from any of the polynucleotide sequences described herein can be used as targets in a microarray. The microarray can be used to monitor the expression level of large numbers of genes simultaneously and to identify genetic variants, mutations, and polymorphisms. This information can be used to determine gene function, to understand the genetic basis of a disorder, to diagnose a disorder, and to develop and monitor the activities of therapeutic agents. Microarrays can be prepared, used, and analyzed using methods known in the art. (See, e.g., Brennan, T. M. et al. (1995) U.S. Pat. No. 5,474,796; Heller, R. A. et al. (1997) Proc. Natl. Acad. Sci. 94: 2150–2155; and Heller, M. J. et al. (1997) U.S. Pat. No. 5,605,662.)

Another embodiment of the subject invention provides nucleic acid sequences encoding the protein of interest which can be extended utilizing a partial nucleotide sequence and various PCR-based methods. This aspect of the invention provides methods for the detection of upstream sequences, such as promoters and regulatory elements. Methods of practicing this aspect of the invention are also well known in the art.

In other embodiments of the disclosed therapeutic regimens, any of the proteins, variants, biologically active fragments, antibodies, complementary sequences, or vectors of the invention can be administered in combination with other appropriate therapeutic agents. Selection of the appropriate agents for use in combination therapy can be made by one of ordinary skill in the art. The combination of therapeutic agents can act synergistically to effect the treatment or prevention of the various disorders described above. In particular, purified protein can be used to produce antibodies or to screen libraries of pharmaceutical agents to identify those which specifically bind the protein of interest. Neutralizing antibodies especially preferred for therapeutic use. Protiens of SEQ ID NO: 287 (Internal Designation 174-5-3-0-H7-CS)

The protein of SEQ ID NO: 287, encoded by human cDNA of SEQ ID NO: 46 (clone 174-5-3-0-H7-CS), is highly homologous (more than 99% identity in amino acids) to the human protein encoded by the CLN8 gene listed in Genbank under accession number AF123757. The two proteins differ by two conservative amino-acid substations (alanine for valine at position 155 and serine for asparagine at position 225). In addition, the protein encoded by 174-5-3-0-H7-CS contains seven transmembrane domains. These domains are located at amino acids 25–45, 71–91, 100–120, 133–153, 160–180, 205–225, and 228–248 as predicted by the software TopPred II (Claros and von Heijne, *CABIOS applic. Notes*, 10:685–686 (1994)). The protein encoded by SEQ ID NO: 287 also exhibits a signal peptide at positions 1–50 and a retention signal KKRP from positions 283 to 286.

CLN8 was identified recently by positional cloning (Ranta et al., Nat Genet. 1999 October;23(2):233–6). CLN8 encodes a 286 amino-acid putative transmembrane protein with no homology to previously known proteins. A naturally-occurring missense mutation in codon 24 (R24G at the border of the first putative transmembrane domain) is the molecular basis for EPMR ("progressive epilepsy with mental retardation", MIM 600143). EPMR, also called Northern Epilepsy, is an autosomal recessive disorder characterized by normal early development, onset of generalized tonic-clonic seizures between the ages of 5 and 10 years, and subsequent progressive mental retardation. Neuropathological findings have shown that EPMR is a new member of the neuronal ceroid lipofuscinosis (NCL) group of neurodegenerative disorders. The NCLs are a genetically heterogeneous group of progressive neurodegenerative disorders characterized by the accumulation of autofluorescent lipopigment in various tissues. CLN8 is the eighth gene to be linked to the NCL group of neuro-degenerative disorders.

Subsequently, the homologous mouse gene (Cln8) was sequenced (82% nucleotide identity with the human gene) and localized to the region of the mouse genome linked to motor neuron degeneration, mouse mnd. Mnd is a naturally-occurring mouse mutant with intracellular autofluorescent inclusions similar to those seen in EPMR. A mutation in mnd mouse DNA was identified, indicating that mnd is a murine ortholog for CLN8 (Ranta et al., Nat Genet. 1999 October;23(2):233–6), and that mice containing mutations in Cln8 represent a murine model for NCL disorders.

Recent experimental evidence has confirmed the transmembrane nature of the CLN8 protein (Lonka L et al., Hum Mol Genet. 2000 Jul. 1;9(11):1691–7). CLN8 resides in the endoplasmic reticulum (ER) and recycles between the ER and the ER-Golgi intermediate compartment (ERGIC) via a KKXX ER-retrieval motif at its C-terminus (KKRP, amino-acids 283–286). This motif is recognized and bound by COPI, a vesicle-coating protein found in retrograde vesicles delivering cargo from the cis Golgi to the ER. The 30 kD CLN8 protein is not processed during its maturation (in particular it is not N-glycosylated). The EPMR-associated R24G mutation does not alter cellular localization in humans.

The subject invention provides a polypeptide encoded by SEQ ID NO: 287 and biologically active fragments of said polypeptide. Compositions comprising polypeptides and pharmaceutically acceptable carriers are likewise provided. Preferred polypeptides, and biologically active fragments thereof, have any of the biological activities or domains/motifs described herein and/or contain the amino acids of positions 155 and 225, 283 to 286. In one embodiment, the protein/polypeptide of SEQ ID NO: 287 is encoded by clone 174-5-3-0-H7-CS.

The ER/ERGIC cellular localization of protein of this invention can be used to target compounds to the ER/ERGIC. This targeting can be observed using any of the techniques known to those skilled in the art including those described in (Lonka L et al., Hum Mol Genet. 2000 Jul. 1;9(11):1691–7). In this aspect of the invention, the protein of SEQ ID NO: 287, or biologically active fragments thereof can be used to target liposomes, vesicles, or colloids to the ER/ERGIC compartment where active agents can be delivered. Methods of making and using targeted liposomes are well known in the art.

In another embodiment, liposomes comprising the protein of SEQ ID NO: 287 can contain a second targeting agent for the specific selection of a target cell. The second targeting agent can be selected for its ability to specifically target a cell or tissue. Thus, the second targeting agent can be specific for tumor markers, such as HER2. Alternatively, markers associated with specific cell types can be used (e.g., CD34, CD4, CD8, etc.). In a preferred embodiment, the second targeting agent is an antibody. Active agents include, but are not limited to, chemotherapeutic agents protein cross-linking agents, inhibitors of protein synthesis, antibacterial agents (e.g., antibiotics), antiviral agents, and/or anti-parasitic agents. The ability to bind the COPI coatomer can be assayed as described in (Cosson P, Letourneur F, Science. 1994 Mar. 18;263(5153):1629–31).

In another embodiment, the present invention provides methods of, and compositions for, identifying specific cellular compartments, such as the ER, ERGIC, and retrograde transport vesicles. This embodiment provides antibodies which specifically bind the protein of SEQ ID NO: 287, or biologically active fragments thereof, which are labeled with detectable markers, such as gold particles, enzymes, radioisotopes, or paramagnetic labels. ER, ERGIC, and retrograde transport vesicles can be identified in samples according to well-known immuno-diagnostic protocols. The antibodies, either monoclonal or polyclonal, can be made according to well-known methods. In a preferred embodiment, the antibodies bind to ER retention signal.

In another embodiment, the protein of the invention or part thereof can be used as a reagent for differential identification of the tissue(s) or cell type(s) present in a biological sample and for diagnosis of diseases and conditions, which include, but are not limited to, asthma, pulmonary edema, atherosclerosis, restenosis, stroke potential, thrombosis and hypertension. Similarly, the protein of the invention, or biologically active fragments thereof, and antibodies thereto can provide immunological probes for differential identification of the tissue(s) or cell type(s). In a number of disorders listed above, particularly of the pulmonary and cardiovascular systems, expression of this protein at significantly higher or lower levels can be routinely detected in certain tissues or cell types (e.g., vascular tissues, cancerous and wounded tissues) or bodily fluids (e.g., lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

Indeed, the 80 first amino-acids of the protein of the invention are identical to two polypeptides claimed in Patent WO 99/35158, hereby incorporated by reference in its entirety (SEQ ID NO:98 and SEQ ID NO:162 corresponding to Geneseq accession numbers Y38413/Y38428 and Y38492) are over-expressed in pulmonary and endothelial tissues.

The tissue distribution in pulmonary and endothelial tissues indicates that the protein product described in WO 99/35158 is useful for the treatment and diagnosis of cardiovascular and respiratory or pulmonary disorders such as asthma, pulmonary edema, pneumonia, atherosclerosis, restenosis, stroke, angina, thrombosis hypertension, inflammation, and wound healing. Those conditions can be diagnosed by determining the amount of the protein of the invention in a sample. Thus, antibodies raised against the protein of SEQ ID NO: 287, or an immunogenic fragment of the protein can be used in diagnostic, prognostic, or screening assays such as those taught in WO 99/35158.

Protiens of SEQ ID No. 270 (Internal Designation 116-119-3-0-H5-CS)

The protein of SEQ ID NO: 270 encoded by the extended cDNA SEQ ID NO: 29 is homologous to the human mitochondrial ATP synthase f subunit or ATPK (E.C. 3.6.1.34) (Swissprot accession number P56134) and is overexpressed in fetal kidney.

The protein of SEQ ID NO: 270, composed of 88 amino acid residues, contains 1 transmembrane segment (position 1 to 55) predicted by the software TopPred II (Claros and von Heijne, *CABIOS applic. Notes*, 10:685–686 (1994). BLAST results show that 100% homology is found between amino acids 5 to 88 of the protein of the invention and amino acids 10 to 93 of human ATP synthase f chain (93 amino acids total), exon 1 of the cDNA SEQ ID NO: 29 making the difference between the 2 proteins (the last 3 exons show 100% homology). Thus, the protein of the invention represents a new isoform of human mitochondrial ATP synthase f subunit. It is interesting to note that the same splice variant is found in bovin, pig and mouse species.

The mitochondrial electron transport (or respiratory) chain is a series of enzyme complexes in the mitochondrial membrane that is responsible for the transport of electrons from NADH to oxygen and the coupling of this oxidation to the synthesis of ATP (oxidative phosphorylation). ATP then provides the primary source of energy for driving a cell's many energy-requiring reactions. ATP synthase (F0 F1 ATPase) is the enzyme complex at the terminus of this chain and serves as a reversible coupling device that interconverts the energies of an electrochemical proton gradient across the mitochondrial membrane into either the synthesis or hydrolysis of ATP. This gradient is produced by other enzymes of the respiratory chain in the course of electron transport from NADH to oxygen. When the cell's energy demands are high, electron transport from NADH to oxygen generates an electrochemical gradient across the mitochondrial membrane. Proton translocation from the outer to the inner side of the membrane drives the synthesis of ATP. Under conditions of low energy requirements and when there is an excess of ATP present, this electrochemical gradient is reversed and ATP synthase hydrolyzes ATP. The energy of hydrolysis is used to pump protons out of the mitochondrial matrix. ATP synthase is, therefore, a dual complex, the F0 portion of which is a transmembrane proton carrier or pump, and the F1 portion of which is catalytic and synthesizes or hydrolyzes ATP. Mammalian ATP synthase complex consists of sixteen different polypeptides (Walker, J. E. and Collinson, T. R. (1994) FEBS Lett.346: 39–43). Six of these polypeptides (subunits alpha, beta, gamma, delta, epsilon, and an ATPase inhibitor protein IF1) comprise the globular catalytic F1 ATPase portion of the complex, which lies outside of the mitochondrial membrane. The remaining ten polypeptides (subunits a, b, c, d, e, f, g, F6, OSCP, and A6L) comprise the proton-translocating, membrane spanning F0 portion of the complex. Like other members of the respiratory chain, all but two of the polypeptide subunits of ATP synthase are nuclear gene products that are imported into the mitochondria. Enzyme complexes similar to mammalian ATP synthase are found in all cell types and in chloroplast and bacterial membranes. This universality indicates the central importance of this enzyme to ATP metabolism. Transcriptional regulation of these nuclear encoded genes appears to be the predominant means for controlling the biogenesis of ATP synthase. Multiple mitochondrial pathologies exist because of the essential role of mitochondrial oxidative phosphorylation in cellular energy production, in the generation of reactive oxygen species and in the initation of apoptosis (Wallace, Science, 283:1482–1488, 1999). It is now clear that mitochondrial diseases encompass an assemblage of clinical problems commonly involving tissues that have high energy requirements such as heart, muscle and the renal and endocrine systems. Over the past 11 years, a considerable body of evidence has accumulated implicating defects in the mitochondrial energy-generating pathway, oxidative phosphorylation, in a wide variety of degenerative diseases including myopathy and cardiomyopathy. Most classes of pathogenic mitochondrial DNA mutations affect the heart, in association with a variety of other clinical manifestations that can include skeletal muscle, the central nervous system (including eye), the endocrine system, and the renal system. Nuclear mutations causing mitochondrial disorders have been described. They are often found in highly conserved subunits. Mitochondrial disorders with nuclear mutations include: myopathies (PEO, MNGIE, congenital muscular dystrophy, carnite disorders), encephalopathies (Leigh, Infantile, Wilson's disease, Deafness-Dystonia syndrome), other systemic disorders and cardiomyopathies.

The discovery of a new ATP synthase subunit, and polynucleotides encoding it satisfy a need in the art by providing new compositions which are useful for the diagnosis, prevention, and treatment of cancer, myopathies, immune disorders, and neurological disorders.

It is believed that the protein of SEQ ID NO: 270 or part thereof plays a role in cellular respiration, preferably as a mitochondrial ATP synthase subunit. Preferred polypeptides of the invention are fragments of SEQ ID NO: 270 having any of the biological activity described herein.

An object of the present invention are compositions and methods of targeting heterologous compounds, either polypeptides or polynucleotides to mitochondria by recombinantly or chemically fusing a fragment of the protein of the invention to an heterologous polypeptide or polynucleotide. Preferred fragments are signal peptide, amphiphilic alpha helices and/or any other fragments of the protein of the invention, or part thereof, that may contain targeting signals for mitochondria including but not limited to matrix targeting signals as defined in Herrman and Neupert, Curr. Opinion Microbiol. 3:210–4 (2000); Bhagwat et al. J. Biol. Chem. 274:24014–22 (1999), Murphy Trends Biotechnol. 15:326–30 (1997); Glaser et al. Plant Mol Biol 38:311–38 (1998); Ciminale et al. Oncogene 18:4505–14 (1999). Such heterologous compounds may be used to modulate mitochondria's activities. For example, they may be used to induce and/or prevent mitochondrial-induced apoptosis or necrosis. In addition, heterologous polynucleotides may be used for mitochondrial gene therapy to replace a defective mitochondrial gene and/or to inhibit the deleterious expression of a mitochondrial gene.

The invention further relates to methods and compositions using the protein of the invention or part thereof to diagnose, prevent and/or treat several disorders in which mitochondrial respiratory electron transport chain is impaired, including but not limited to mitochondriocytopathies, necrosis, aging, myopathies, cancer and neurodegenerative diseases such as Alzheimer's disease, Huntington's disease, Parkinson's disease, epilepsy, Down's syndrome, dementia, multiple sclerosis, and amyotrophic lateral sclerosis. For diagnostic purposes, the expression of the protein of the invention could be investigated using any of the Northern blotting, RT-PCR or immunoblotting methods described herein and compared to the expression in control individuals. For prevention and/or treatment purposes, the protein of the invention may be used to enhance electron transport and increase energy delivery using any of the gene therapy methods described herein or known to those skilled in the art.

In another embodiment, The invention further relates to methods and compositions using the protein of the invention or part thereof to diagnose, prevent and/or treat several disorders in which mitochondrial respiratory electron transport chain needs to be impaired, including but not limited to Sjogren's syndrome, Addison's disease, bronchitis, dermatomyositis, polymyositis, glomerulonephritis, diabetes mellitus, emphysema, Graves' disease, atrophic gastritis, lupus erythematosus, myasthenia gravis, multiple sclerosis, autoimmune thyroiditis, ulcerative colitis, anemia, pancreatitis, scleroderma, rheumatoid and osteoarthritis, asthma, allergic rhinitis, atopic dermatitis, dermatomyositis, polymyositis, and gout, using any techniques known to those skilled in the art including the antisense or triple helices strategies described herein.

Moreover, antibodies to the protein of the invention or part thereof may be used for detection of mitochondria organelles and/or mitochondrial membranes using any techniques known to those skilled in the art.

Protiens of SEQ ID NO: 271 (Internal Designation 117-001-5–0-G3-CS)

The protein of SEQ ID NO: 271 is homologous to the family of lipopolysaccharide (LPS) binding proteins (LBPs). Several families of proteins have the ability to bind LPS including (a) the lipopolysaccharide-binding proteins (LBPs), and (b) the bactericidal permeability-increasing proteins (BPIs). Cholesteryl ester transfer protein (CETP), which is involved in the transfer of insoluble cholesteryl esters in reverse cholesterol transport, shares some homology to members of the LPS binding family of proteins.

Lipopolysaccharide (LPS), alternatively known as bacterial endotoxin, is a major component of the outer membrane of Gram-negative bacteria. It consists of serotype-specific O-side chain polysaccharides linked to a core oligosaccharide and Lipid A. LPS is a potent mediator of the inflammatory response and stimulates the expression of many pro-inflammatory and pro-coagulant compounds in monocytes, macrophages, and endothelial cells. While these responses are important in containing and eliminating localized infections, systemic exposure to LPS can lead to a number of adverse effects. These include: (a) induction of an inflammatory cascade, (b) damage to the endothelium, (c) widespread coagulopathies, and (d) organ damage.

Systemic exposure to LPS can arise from direct infection by Gram-negative bacteria, leading to the complications of Gram-negative sepsis. Examples of diseases which are associated with Gram-negative bacterial infection or endotoxemia (including bacterial meningitis, neonatal sepsis, cystic fibrosis, inflammatory bowel disease, and liver cirrhosis), Gram-negative pneumonia, Gram-negative abdominal abscess, hemorrhagic shock, and disseminated intravascular coagulation. Subjects who are leukopenic or neutropenic, including subjects treated with chemotherapy or immunocompromised subjects, are particularly susceptible to bacterial infection and the subsequent effects of endotoxin exposure.

Gram-negative sepsis remains one of the primary causes of severe systemic inflammation in hospitalized and immunocompromised patients. Alternatively, changes in gut permeability by a variety of circumstances, including trauma, can lead to translocation of bacteria/LPS into the bloodstream. Bacteria translocated from the gut is thought to play a major role in post-surgical immunosuppression (Little et al., Surgery. 114: 87–91 (1993)) and hemorrhagic shock. Therefore, there is a great interest to characterize proteins involved in the biological response to LPS and to discover therapies that can counteract the effects of LPS in pathological situations.

LBP is a 60 kDa glycoprotein synthesized in the liver and present in normal human serum. LBP expression is upregulated in response to infectious, inflammatory, and toxic mediators. LBP expression has been induced in animals challenged with LPS, silver nitrate, turpentine, and *Corynebacterium parvum* (Geller et al., Surgery 128:22–28 (1993); Gallay et al., Infect. Immun. 61:378–383 (1993); Tobias et al., J. Exp. Med. 164:77–793 (1986)). LBP levels are correlated with exposure to LPS, and elevated levels (particularly persistent elevated levels) have been correlated with poor clinical outcomes in septic patients (U.S. Pat. Nos. 5,484,705, and 5,804,367, hereby incorporated by reference in their entirety).

A portion of the LBP molecule (the N-terminal 1–197 aa) binds to the lipid A portion of the LPS molecule to form a high affinity LBP/LPS complex (Tobias, et al., J. Biol. Chem 264: 10867–10871 (1989)). The LBP/LPS complex potentiates the cellular response to LPS via an interaction with the monocytic differentiation antigen CD14 (Wright et al., Science. 249: 1431–1433 (1990); Lee et al., J. Exp. Med. 175:1697–1705 (1992)). LPS can be transferred from LBP to membrane-bound or soluble CD14. Activated CD14 can then interact with endothelial cells to elicit an inflammatory response. The C-terminal portion of LBP is required to transfer LPS to CD14 (U.S. Pat. No. 5,731,415; Theofan et al., J. Immunol. 152:3624–29 (1994); Han et al., J. Biol. Chem. 269:8172–75 (1994)). Evidence also suggests that LBP can neutralize LPS by an interaction with serum lipoproteins or through the internalization of an LBP/LPS/CD14 complex by neutrophils (Wurfel et al., J. Exp. Med. 180:1025–1035 (1994); Wurfel et al., J. Exp. Med. 181:1743–54 (1995); Gegner et al., J. Biol. Chem. 20:5320–5325 (1995)).

The subject invention provides the polypeptide of SEQ ID NO: 271 and polynucleotide sequences encoding the amino acid sequence of SEQ ID NO: 271. In a one embodiment, the polypeptides of SEQ ID NO: 271 are interchanged with the polypeptides encoded by the human cDNA of clone 181-20-3-0-B5-CS. Also included in the invention are biologically active fragments of the protein of SEQ ID NO: 271 and polynucleotide sequences encoding these biologically active fragments. In a preferred embodiment, biologically active fragments of SEQ ID NO: 271 are encoded by clone 181-20-3-0-B5-CS and comprise the first 181 amino acids encoded by clone 181-20-3-0-B5-CS. "Biologically active fragments" are defined as those peptide or polypeptide fragments of SEQ ID NO: 271 which have at least one of the biological functions of the full length protein (e.g., the ability to bind bacterial LPS).

The invention also provides variants of SEQ ID NO: 271. These variants have at least about 80%, more preferably at least about 90%, and most preferably at least about 95% amino acid sequence identity to the amino acid sequence of SEQ ID NO: 271. Variants according to the subject invention also have at least one functional or structural characteristic of SEQ ID NO: 271, such as the biological functions described above. The invention also provides biologically active fragments of the variant proteins. Unless otherwise indicated, the methods disclosed herein can be practiced utilizing the polypeptide of SEQ ID NO: 271 or variants thereof. Likewise, the methods of the subject invention can be practiced using biological fragments of the protein of SEQ ID NO: or variants of said biologically active fragments.

Because of the redundancy of the genetic code, a variety of different DNA sequences can encode SEQ ID NO: 271. It is well within the skill of a person trained in the art to create these alternative DNA sequences which encode proteins having the same, or essentially the same, amino acid sequence. These variant DNA sequences are, thus, within the scope of the subject invention. As used herein, reference to "essentially the same sequence" refers to sequences that have amino acid substitutions, deletions, additions, or insertions that do not materially affect biological activity. Fragments retaining one or more characteristic biological activity of SEQ ID NO: are also included in this definition.

"Recombinant nucleotide variants" are alternate polynucleotides which encode a particular protein. They can be synthesized, for example, by making use of the "redundancy" in the genetic code. Various codon substitutions, such as the silent changes which produce specific restriction sites or codon usage-specific mutations, can be introduced to optimize cloning into a plasmid or viral vector or expression in a particular prokaryotic or eukaryotic host system, respectively.

The protein of SEQ ID NO: 271, and variants thereof, can be used to produce antibodies according to methods well known in the art. The antibodies can be monoclonal or polyclonal. Antibodies can also be synthesized against fragments of SEQ ID NO: 271, as well as variants thereof, according to known methods. The subject invention also provides antibodies which specifically bind to biologically active fragments of SEQ ID NO: 271 or biologically active fragments of SEQ ID NO: 271 variants.

The subject invention also provides for immunoassays which are used to screen for, monitor, or diagnose exposure to LPS. In one embodiment, diagnostic assays measure the level of LBP in patient plasma samples. LBP levels are known to rise in response to exposure to LPS, thus the measurement of the level of the protein of SEQ ID NO: 271 can provide an early indication of Gram-negative infection or of endotoxin exposure.

The subject invention provides methods of treating individuals infected with Gram negative bacteria comprising the administration of therapeutically-effective compositions comprising SEQ ID NO: 271. In one embodiment, the protein lacks the C-terminal portion (or portions of the C-terminal domain) necessary to transfer LPS to CD14. LPS can be scavenged by the excess N-terminal fragment and would be unable to induce an inflammatory response (see, e.g., U.S. Pat. No. 5,731,415, hereby incorporated by reference in its entirety).

Another aspect of the subject invention provides methods of prophylaxis. The method treats individuals by administration of therapeutically-effective amounts of compositions comprising SEQ ID NO: 271. Instances where this aspect of the invention can be performed include, but are not limited to, conditions associated with increased translocation of gut bacteria and endotoxin, particularly prior to surgery. In addition, patients who are at risk for potential Gram-infection, including but not limited to patients undergoing chemotherapy, or patients who are immunocompromised (for example with AIDS) can benefit from such treatment. Such uses are described in U.S. Pat. No. 5,990,082, hereby incorporated by reference in its entirety.

The N-terminal portion of LBP, which lacks the ability to induce an inflammatory response, can be fused to other proteins or fragments thereof (such as the bactericidal/permeability-increasing protein or BPI) which can increase the association of these molecules with LPS and aid in the clearance of endotoxin from patients who have been exposed to Gram negative bacteria. Such preparations can be used to treat and inhibit a number of Gram-negative infections, Gram positive, or fungal infections, as described in the following patents: WO 95/19179 A, WO 95/19180 A, WO 95/19372 A, and WO 96/34873 A, each of which is incorporated by reference in its entirety.

The subject invention also provides methods of removing endotoxin from recombinantly-produced proteins. In one embodiment, the recombinantly-produced proteins are obtained from Gram-negative bacteria. In a preferred embodiment, the bacteria are E. coli. In another embodiment, the protein of SEQ ID NO: 271, biologically active fragments thereof, variants, or derivatives thereof, are contacted with compositions comprising recombinantly-produced proteins. The contacting step can take place with SEQ ID NO: 271 immobilized on a substrate or with SEQ ID NO: 271 present in free solution.

In addition, protein of SEQ ID NO: 271, biologically active fragments, or derivatives thereof, can be used in diagnostic assays to measure the level of LPS in patient plasma samples. In such an assay, serum samples would be bound to a solid matrix, such as a membrane, plastic, treated plastic, or other supports, and then cloned with the protein of SEQ ID NO: 271. Visualization can be achieved by fusing protein of SEQ ID NO: to any number of enzymes followed by treatment with a chromogenic, fluorogenic, or luminescent substrate. Alternatively, the protein of SEQ ID NO: 271, biologically active fragments, variants, or derivatives thereof, can be linked to a fluorescent or luminescent protein or compound. The linkage can be chemical or made by recombinant techniques known to those skilled in the art. In addition, antibodies raised against the protein of SEQ ID NO: 271, biologically active fragments, variants, or derivatives thereof can be used to visualize the LPS/protein 271 complexes using immunoassays known to those skilled in the art.

Protiens of SEQ ID NO:266 (Internal Designation Clone 116-110-2-0-F4-CS)

The protein of SEQ ID NO:266, highly expressed in the testis, is encoded by cDNA of SEQ ID NO:25 and exhibits homology to the Ly-6 family of GPI-linked cell-surface glycoproteins composed of one or more copies of a conserved domain of about 100 amino-acid residues (PS00983; LY6_UPAR).

The protein of SEQ ID NO:266, Ly-6Z shows significant structural similarities to Ly-6 antigens, human CD59, and a herpes virus CD59 homolog. Ly-6Z displays one copy of the motif of the urokinase-type Plasminogen Activator Receptor (u-PAR)/Ly-6 domain, a carboxy-terminal hydrophobic domain necessary for GPI anchoring in a membrane,and numerous disulfide bonds that stabilize its tertiary structure. Furthermore, the 124 amino-acid long Ly-6Z proteinis a novel member of the Ly-6 protein family. A preferred embodiment of the invention is directed toward the compositions of SEQ ID NO:25, SEQ ID NO:266, and Clone 116-110–2-0-F4-CS. Preferred polypeptides of the invention are any fragments of SEQ ID NO:266 having any of the biological activities described herein.

Ly-6Z polypeptides are differentially expressed in several hematopoietic lineages and function in signal transduction and cell activation Ly-6Z is also expressed in brain tissue (primarily associated with vascular elements throughout the brain). Ly-6Z expression is greatly induced by IFN-β in various tissues and cell lines and is associated with tyrosine kinase activity in T cells. Further, the IFNs are important in the generation of memory CD8+ T cells, and it has been demonstrated that the expression of Ly-6Z is a strong marker for the memory phenotype. Ly-6Z is also inducible by retinoic acid during differentiation of acute promyelocytic leukemia cells. Further, cultured glial and neuronal cells express high levels of Ly-6Z following incubation with cytokines, including rIFN-gamma. Ly-6Z expression is also upregulated in response to estradiol and intermittent mechanical loading, suggesting a role in bone homeostasis.

Ly-6Z also regulates plasminogen mediated extracellular proteolysis. Surface plasminogen activation controls the connections between cells, basement membrane and extracellular matrix, and therefore the capacity of cells to migrate and invade neighboring tissues (Roldan A L et al. EMBO J 9(2):467–474 (1990)). Certain factors of the PA system, such as Ly-6Z, have been detected in organs of the male reproductive tract in various species. The morphological study provide support for the involvement of the PA system in human male reproductive physiology (Gunnarsson M et al. Mol Hum Reprod 5(10):934–940 (1999)). In a preferred embodiment of the invention, Ly-6Z polypeptides or fragments thereof are used to treat reproductive disorders such as male sterility. This method comprises the step of contacting a sperm-motility inducing amount of Ly-6Z polypeptides or fragments thereof with cells of the reproductive system in a physiologically-acceptable solution (e.g., pH-buffered saline). Delivery of said polypeptides may be accomplished by injection or implantation.

Consistent with a role in extracellular proteolysis, Ly-6Z expression level is higher in highly malignant cells than in tumor cells with a lower malignancy phenotype. LY-6Z is also highly expressed on non-lymphoid tumor cells. Cells derived from angiogenic tumors express a higher tumorigenicity phenotype and a higher capacity to produce artificial pulmonary metastases than cells from the poorly angiogenic tumors. These cells also express significantly higher levels of the lymphocyte activation protein Ly-6Z. Ly-6Z also blocks secretion of interleukin II (IL-2) which is an anti-cancer agent and a key regulatory hormone in cell-mediated immunity (Fleming T J and T R Malek J Immunol 153:1955–62 (1994)). IL-2 stimulates the proliferation of both T and natural killer cells and activates NK cells to directly lyse freshly isolated, solid tumor cells.

In a preferred embodiment of the invention, Ly-6Z polypeptides or fragments thereof are used to generate antibodies using any technique known to those skilled in the art. In a further embodiment, antibodies that bind to Ly-6Z polypeptides or fragments thereof are used to selectively identify cells or tissues. Additionally, developmental and malignant disorders may be diagnosed using this method. Preferred cells are those of the testis including sperm cells. Further preferred cells are those of a hematopoetic lineage. Further preferred cells are those derived from cancerous tissue, tissues suspected of being cancerous, or metastatic cancers. Further preferred cells are those suspected of lupus nephritis. This method comprises the steps of contacting said antibody with a cell sample or biopsy and detecting specific binding by methods common to the art such as fluorescent or radioactive labeling of the antibody.

In another embodiment of the invention, antibodies which bind to Ly-6Z polypeptides or fragments thereof are used to prevent metastasis of cancerous or precancerous cells. Preferred cells include human urogenital cells, angiogenic cells, and hematopoetic cells. Such antibodies can be used alone or bound to a substance capable of ablating or killing cells as a therapy for urogenital disorders or cancers in which the protein of the invention is overexpressed. This method comprises the step of contacting said antibodies with a cell, preferably a cell that expresses Ly-6Z polypeptides on its surface. Delivery of said antibodies may be accomplished by injection.

Normally, human blood cells are protected against autologous complement activation by membrane proteins that block the assembly of functional complement pores. One such protein is human Ly-6Z. Administration of Ly-6Z prevents hemolytic disease or thrombosis. Further, the Ly-6Z protein may prevent the complement-mediated lysis and activation of endothelial cells that leads to hyper acute rejection, and therefore may be administered during xenogeneic organ transplantation. Therefore, in another embodiment of the invention, Ly-6Z polypeptides or a polynucleotide construct comprising polynucleotides encoding said polypeptides are used to prevent complement lysis of a cell. This method comprises the step of introducing Ly-6Z polypeptides or said polynucleotide construct to a cell by methods common to the art. For example, polypeptides may be introduced by GPI-linkage to a cell sample. Alternatively, a polynucleotide construct comprising polynucleotides encoding Ly-6Z polypeptides is introduced to cells, for example, by transfection or viral transduction (including attenuated lentiviral and adenoviral systems) as discussed in U.S. Pat. No. 6,204,060, which disclosure is hereby incorporated by reference in its entirety. This method may be administered during xenogeneic tissue transplantation to prevent complement-mediated lysis of foreign tissue In addition, prevention of complement-mediated lysis may be particulary important in human and animal reproductive therapy, where functional survival of the germ cells during in vitro handling is crucial. Storage of sperm is of widespread importance in commercial animal breeding programs, human sperm donor programs, and in the treatment of certain disease states. For example, sperm samples may be frozen for men who have been diagnosed with cancer or other diseases that may eventually interfere with sperm production, as well as for assisted reproduction purposes where sperm may be stored for use at other locations or times. The procedures utilized in such cases include: washing a sperm sample to separate out the sperm-rich fraction from non-sperm components of a sample such as seminal plasma or debris; further isolating the healthy, motile sperm from dead sperm or from white blood cells in an ejaculate; freezing or refrigerating of sperm for use at a later date or for shipping to females at differing locations; extending or diluting sperm for culture in diagnostic testing or for use in therapeutic interventions such as in vitro fertilization or intracytoplasmic sperm injection (Cohen et al. 12: 994–1001 (1997)). Once sperm have been washed or isolated, they are then extended (or diluted) in culture or holding media for a variety of uses (sperm analysis, diagnostic tests, assisted reproduction). Each of these uses for extended or diluted sperm requires a somewhat different formulation of basal medium (see, for review, U.S. Pat. No. 6,140,121 Ellington et al. October 2000); however, in all cases sperm survival is suboptimal outside of the female reproductive tract. Novel additional components of a dilution or storage medium which could improve the functional preservation of sperm would be useful. Therefore, in another preferred embodiment of this invention, Ly-6Z polypeptides are used in a method to protect sperm cells. The methods used to compose such preservation media are generally known by those skilled in the art (for ex., Oliver S. A. et al. U.S. Pat. No. 5,897,987 April 1999; Cohen J. et al., supra). Inversely, in yet another embodiment of this invention, ligands, inhibitors, neutralizing antibodies or other biological agents which bind to Ly-6Z polypeptides or fragments thereof are used as components of pharmacological formulations designed for male contraception purposes.

In still another embodiment of this invention, chimeric ligands or derivatives which recognize the protein of the invention or part thereof and which could be internalized into cell can be used to design a system of drug delivery finely targeted toward urogenital and other tissues which express the protein of SEQ ID NO:266. For example, such recognizing molecules can be incorporated into the membranes of liposomes to allow the specific delivery of the liposomes to cells expressing the protein of SEQ ID NO:266. Methods of designing such drug delivery systems are known by those skilled in the art (Smith H. J. Introduction to the principles of drug design and action, $3^{rd}$ ed. (1998)).

Proteins SEQ ID NOs:417, 413, 418 (Internal Designations 188-45-1-0-D3-CS, 188-26-4-0-F5-CS, and 188-5-1-0-H6-CS)

The proteins of SEQ ID NOs:417, 413, and 418, encoded by the cDNAs of SEQ ID NOs: 176, 172, and 177, are expressed in the brain and exhibit strong homology with proteins with redox activity (see, e.g. Genbank accession numbers AK001293 and AF029689, and Geneseqp accession number: Y59180).

The protein of SEQ ID No:418 (320 amino acids) is a variant of AK001293 (322 amino acids). AK001293 has six extra nucleotides, within the same ORF, as SEQ ID No:418, producing a longer protein. SEQ ID NO:418 exhibits the Pfam Zinc-binding dehydrogenase (adh zinc) signature from positions 16 to 313. SEQ ID NO:418 presents all the conserved residues of the motif except for a histidine that is thought to be a zinc-ligand. This lack of zinc-ligand residues is a feature of the quinone oxidoreductases (QOR), a subfamily of zinc-binding dehydrogenases.

SEQ ID NO:413 (191 amino acids) shares the first 172 amino acids with SEQ ID NO:418. The deletion of one nucleotide at position 583 in the SEQ ID NO:413 cDNA sequence (corresponding to amino acid 173), however, creates a change of ORF compared to SEQ ID NO:418 and AK001293.

SEQ ID NO:417 is a short protein (20 amino acids) whose sequence corresponds to the N-terminal end of the other proteins of the invention. The presence of a T (instead of a G in public sequences and SEQ ID NOs:413 and 418) at position 128 on the cDNA creates a STOP codon, creating a shorter protein.

SEQ ID NOs:417, 413 and 418 are similar to the QORs, a family of zinc-binding dehydrogenases. QORs are cytoplasmic redox-regulated flavoenzymes that catalyze the one or two-electron reduction of quinones. QORs bind NADP and are inhibited by dicoumarol.

The activity of QORs protects cells against toxicity, mutagenicity, and cancer due to exposure to environmental and synthetic quinones and their precursors. Thus, QORs play a central role in monitoring cellular redox state and act to protect against oxidative stress induced by a variety of metabolic situations (Raina A. K. et al. (1999) Redox Rep. 4:23–7). The oxidoreductase activity also permits the activation of bioreductive anticancer drugs (Begleiter A. et al. (1996) Br. J. Cancer Suppl. 27:S9–14).

The metabolism of quinones involves enzymatic reduction of the quinone by one or two electrons. In the activation of quinone-containing antitumor agents, this reduction results in the formation of the semiquinone or the hydroquinone of the anticancer drug. The consequence of these enzymatic reductions is that the semiquinone yields its extra electron to oxygen with the formation of superoxide radical anion and the original quinone. This reduction by a reductase followed by oxidation by molecular oxygen (dioxygen) is known as redox-cycling and continues until the system becomes anaerobic. In the case of a two-electron reduction, the hydroquinone could become stable, and as such, be excreted by the organism in a detoxification pathway.

The cellular antioxidant response is mediated by a battery of detoxifying/defensive proteins. The promoters of genes that encode these proteins contain a common cis-element termed the antioxidant response element (ARE). Many transcription factors, including Nrf, Jun, Fos, Fra, Maf, YABP, ARE-BP1, Ah (aromatic hydrocarbon) receptor, and estrogen receptor bind to the ARE from various genes. Among these factors, Nrf-Jun heterodimers positively regulate ARE-mediated expression and induction of genes in response to antioxidants and xenobiotics (reviewed in Dhakshinamoorthy S. et al. (2000) Curr. Top Cell Regul. 36:201–16). On the other hand, c-Fos represses ARE-mediated gene expression (Venugopal, R., and Jaiswal, A. K. (1996) Proc. Natl. Acad. Sci. USA 93, 14960–5).

Elevated levels of QOR activity have been reported in several kinds of tumors such as liver, colon, lung and breast (Belinsky M., Jaiswal A. K., (1993) Cancer Metastasis Rev 12:103–17). Bioreactive antitumor agents are an important class of anticancer drugs that require activation by reduction. For this reason, QORs are a potential target on which to base the development of new antitumor compounds. Certain QORs have already been implicated in the metabolism, activation and mechanism of cytotoxicity of some anticancer drugs such as mitomycin C, indoloquinone E09 (Ross D. et al. (1994) Oncol. Res. 6:493–500), CB 1954 (Knox R. J. et al. (2000) Cancer Res. 60:4179–86) or antiestrogens in breast cancer (Montano M. M., Katzenellenbogen B. S. (1997) PNAS 94:2581–6).

In addition, some of the proteins of the QOR family are thought to play a role in the prevention of apoptosis following oxidative stress. The tumor suppressor gene p53 has been directly implicated in the induction of apoptosis in dividing cells and in hippocampal pyramidal neurons (Jordan J. et al. (1997) J. Neurosci 17:1397–405) and a QOR gene has been described as a p53-regulated gene (Kostic C, Shaw P. H. (2000) Oncogene 19:3978–87).

It is believed that the proteins of SEQ ID NOs:417, 413 and 418 have a redox activity, most likely as QORs. Thus, they are expected to act as an endogenous antioxidant against oxidative stress and may be able to use NADP as cofactor. The proteins of the invention may be used to deactivate toxins and to activate bioreductive anticancer drugs. In addition, they may prevent apoptosis following oxidative stress and be regulated by p53. Because proteins SEQ ID NOs:417 and 413 do not contain the Pfam Zinc-binding dehydrogenase (adh zinc) signature, in contrast to SEQ ID NO:418, they may act as a competitive inhibitor, i.e. a dominant negative form, of the functional protein.

The oxidoreductase activity of the proteins of the invention may be assayed using any technique known to those skilled in the art. For example, the measurement of the rate of oxidation of NADPH and oxygen consumption, and the detection of the semiquinone and reactive oxygen species, may be performed as described by Gutierrez P. L. (Gutierrez P. L. (2000) Front. Biosci. 5:D629–38), or by any other method skilled in the art. The enzymatic activity of the proteins of the invention in different affected and control tissues may be assayed by histochemical staining. To confirm the role of the proteins of the invention in the cellular antioxidant response, in vitro and in vivo assays may be performed. Transcription levels of the genes coding for the proteins of the invention may be measured using standard techniques after exposure to quinones or derived compounds as beta-naphtoflavone (beta-NF), as described by Belinsky M. and Jaiswal A. K. (supra), as well as in response to transcription factors such as Nerf, Jun and c-Fos, or in the presence of p53.

In one embodiment of the present invention, the present protein can be used to detect specific cell types in vitro or in vivo. For example, as the present proteins are overexpressed in the brain, reagents capable of specifically recognizing the present protein can be used as markers for brain cells. Brain-specific markers have a number of uses, including for the identification of specific tissues for histological analyses, as well as to detect the origin of tumor cells. In addition, as the expression of the present protein is likely induced by transcription factors such as Nrf, Jun, Fos, Fra, Maf, YABP, ARE-BP1, Ah (aromatic hydrocarbon) receptor, and estrogen receptor, as well as by p53, reagents specific for detecting the present protein can also be used as a marker for the activity of any of these proteins in vitro or in vivo. In view of the association between many of these proteins and diseases such as cancer, the ability to detect the presence or absence of the proteins provides powerful tools for disease diagnosis and screening. For any of these applications, the expression of the present protein can be detected using any standard method, including Northern blots, western blots, in situ hybridization, PCR, etc.

In another embodiment, the proteins of the invention can serve as markers for cellular oxidative stress in vivo and in vitro. As such, the proteins of the invention or part thereof may be useful in the diagnosis of disorders in which oxidative stress is implicated, including a large variety of types of cancer as well as neurodegenerative disorders such as Alzheimer's disease (AD), amyothropic lateral sclerosis (ALS) or Parkinson disease (PD). For diagnostic purposes, the expression of the protein of the invention may be investigated using, e.g. Northern blotting, RT-PCR or immunoblotting methods and compared to the expression in control individuals. An increased levels of the proteins of the invention in patients compared with controls indicates a major shift in redox balance and, thus, indicates the presence of the disease or of a susceptibility for the disease.

The invention further relates to methods and compositions using the proteins of the invention or part thereof to prevent and/or treat disorders in which oxidative stress is implicated, including those mentioned above. For these purposes the proteins themselves, or polynucleotides encoding the proteins, or an activator of protein expression may be administrated to patients, or to disease-free individuals in case of increased susceptibility to one of these disorders.

In another embodiment, the protein of the invention or part thereof is used to prevent cells from undergoing apoptosis. They may thus be useful in the diagnosis, treatment and/or prevention of disorders and processes in which apoptosis is deleterious, including but not limited to immune deficiency syndromes (including AIDS), type I diabetes, pathogenic infections, cardiovascular and neurological injury, alopecia, aging, degenerative diseases including AD and PD, dystonia, Leber's hereditary optic neuropathy and schizophrenia. For all such diagnostic purposes, the expression of the proteins of the invention can be investigated using any of the Northern blotting, RT-PCR or immunoblotting methods described herein and compared to the expression in control individuals.

The invention relates to methods and compositions using the proteins of the invention or part thereof as detoxifying enzymes against quinones. There are a variety of quinones with a toxic effect in cells (e.g. quinones derived from the oxidation of phenolic metabolites of benzene, DA-quinones, or menadione). Thus, the proteins of the invention or part thereof may be protective against the hematotoxic and carcinogenic effects of benzene, as well as against benzene-caused diseases such as cancer, aplastic anemia and pancytopenia. Moreover, they may detoxify DA-quinones in the brain, thereby providing neuroprotection in Parkinson's Disease. In still another embodiment, the proteins of the invention or part thereof may protect cells against menadione-induced oxidative stress, with known effects on myocardial cells (Floreani M. et al (2000) Biochem Pharmacol. 60:601–5). For prevention and/or treatment purposes the proteins themselves, or polynucleotides encoding the proteins, or an activator of protein expression may be administrated.

In another embodiment, the present proteins may be a target of chemotherapy specific to different kinds of cancer, to ensure a favorable response to anticancer drugs. Specifically, proteins of the invention or part thereof may be used as an activator of cytotoxic prodrugs of quinone family. Accordingly, the protein of the invention or part thereof may be administered to a patient in conjunction with a bioreductive anticancer agent in order to activate the drug. This co-administration may be by simultaneous administration, such as a mixture of the oxidoreductase and the drug, or by separate simultaneous or sequential administration. Cancer-specific antitumor agents based on QOR substrates may be designed as described by Xing J. et al. (Xing J. et al. (2000) Med. Chem. 43:457–66) and assayed as described in Li B. et al. (Li B et al. (1999) Chem. Res. Toxicol. 12:1042–9). Alternatively, as the present proteins may be overexpressed in tumor cells, such methods may be performed by simply detecting the level of the present protein in tumor cells, and administering the prodrug specifically to those patients found to have elevated levels of the protein in their tumor cells.

Proteins of SEQ ID NOs:415, 310, 317 (Internal Designation 188-29-2-0-H1-CS, 188-18-4-0-A9-CS, 188-9-2-0-E1-CS)

Mammalian inositol hexakiphosphate kinase 2 (IP6K2), an enzyme of the inositol phosphate pathway, has been cloned and described by two independent groups [Saiardi, A.; Erdument-Bromage, H.; Snowman, A. M.; Tempst, P.; and Snyder, S. H., (1999) Current Biology 9, 1323–1326, and Katai, K.; Miyamoto, K-I.; Kishida, S.; Segawa, H.; Nii, T.; Tanaka, H.; Tani, Y.; Arai, H.; Tatsumi, S.; Morita, K.; Taketani, Y.; and Takeda, E. (1999) Biochem. J. 343, 705–712]. Newly identified consensus sequences of inositolpolyphosphate kinases are represented by [LV]-[LA]-[DE]-X(3–8)-P-X-[VAI]-[ML]-D-X-K-[ML]G [Saiardi, A.; Erdument-Bromage, H.; Snowman, A. M.; Tempst, P.; and Snyder, S. H. (1999) Current Biology 9, 1323–1326]. IP6K2 catalyzes the transfer of phosphate groups from InsP6 or Ins(1,3,4,5,6)P5 (the substrate), to another protein or small molecule, such as a nucleoside di-phosphate.

The subject invention provides the polypeptides of SEQ ID NOs:415, 310, and 317, encoded by the cDNAs of SEQ ID NOs:174, 69, and 76, respectively. The invention also provides biologically active fragments of SEQ ID NOs:415, 310, and 317. In one embodiment, the polypeptides of SEQ ID NOs:415, 310, and 317 are interchanged with the corresponding polypeptides encoded by the human cDNA of clone 188-29–2–0-H1-CS, 188-18–4-0-A9-CS, or 188-9–2–0-E1-CS. "Biologically active fragments" are defined as those peptide or polypeptide fragments having at least one of the biological functions of the full length protein (e.g., kinase activity). Compositions of the protein/polypeptide of SEQ ID NOs:415, 310, or 317, or biologically active fragments thereof, are also provided by the subject invention. These compositions may be made according to methods well known in the art.

The invention also provides variants of the protein of SEQ ID NOs:415, 310, or 317. These variants have at least about 80%, more preferably at least about 90%, and most preferably at least about 95% amino acid sequence identity to the amino acid sequences encoded by SEQ ID NOs:415, 310, and 317. Variants according to the subject invention also have at least one functional or structural characteristic of the protein of SEQ ID NOs:415, 310, or 317. The invention also provides biologically active fragments of the variant proteins. Compositions of variants, or biologically active fragments thereof, are also provided by the subject invention. These compositions may be made according to methods well known in the art. Unless otherwise indicated, the methods disclosed herein can be practiced utilizing the protein encoded by SEQ ID NO:415, 310, or 317, biologically active fragments of SEQ ID NO:415, 310, or 317, variants of SEQ ID NO:415, 310, or 317, and biologically active fragments of the variants.

Because of the redundancy of the genetic code, a variety of different DNA sequences can encode the amino acid sequence of SEQ ID NO:415, 310, or 317. In a preferred embodiment, SEQ ID NO:415, 310, or 317 is encoded by clone 188-29-2-0-H1-CS, 188-18-4-0-A9-CS, or 188-9-2-0-E1-CS, or by the cDNAs of SEQ ID NO:174, 69, or 76. It is well within the skill of a person trained in the art to create these alternative DNA sequences which encode proteins having the same, or essentially the same, amino acid sequence. These variant DNA sequences are, thus, within the scope of the subject invention. As used herein, reference to "essentially the same" sequence refers to sequences that have amino acid substitutions, deletions, additions, or insertions that do not materially affect biological activity. Fragments retaining one or more characteristic biological activity of the protein encoded by SEQ ID NO:415, 310, or 317 are also included in this definition.

In one aspect of the subject invention, SEQ ID NO:415, 310, or 317, and variants thereof, can be used to generate polyclonal or monoclonal antibodies. Both biologically active and immunogenic fragments of SEQ ID NO:415, 310, or 317, or variant proteins, can be used to produce antibodies. Polyclonal and/or monoclonal antibodies can be made according to methods well known to the skilled artisan. Antibodies produced in accordance with the subject invention can be used in a variety of detection assays known to those skilled in the art. The antibodies may be used to agonize or antagonize the biological activity of the protein of SEQ ID NO:415, 310, or 317.

The protein of SEQ ID NO:415, 310, or 317 can be used for the synthesis of nucleoside triphosphate (NTP) compounds. In one embodiment, the NTP compound produced is ATP, GTP, CTP, or TTP. In this aspect of the subject invention, SEQ ID NO:415, 310, or 317 removes a phosphate from InsP6 or Ins(1,3,4,5,6)P5 and transfers it to a nucleoside diphosphate (e.g., ADP, CTP, GDP, or TDP) to create a NTP. The conditions and methods for the synthesis of NTP compounds, such as ATP, are well known to the skilled artisan. Thus, the protein of SEQ ID NO:415, 310, or 317 has industrially useful function for the synthesis of commercially valuable products.

The subject invention also provides methods of determining the relative amounts of InsP6 or Ins(1,3,4,5,6)P5 in the cell by a kinase assay. In this aspect of the invention, SEQ ID NO:415, 310, or 317 can be used to transfer phospate groups from InsP6 or Ins(1,3,4,5,6)P5 to acceptor substrates according to well-known kinase activity assays.

Protiens of SEQ ID NO:294 (Internal Designation 181-16-2-0-A7-CS)

The protein of SEQ ID NO:294 is encoded by the cDNA of SEQ ID NO:53. It will be appreciated that all characteristics and uses of the polypeptide of SEQ ID NO:294 described throughout the present application also pertain to the polypeptide encoded by the human cDNA of clone 181-16-2-0-A7-CS. In addition, it will be appreciated that all characteristics and uses of the nucleic acid of SEQ ID NO:53 described throughout the present application also pertain to the human cDNA of clone 181-16-2-0-A7-CS.

This gene was isolated from fetal liver and expression has also been detected in fetal kidney, placenta, liver, brain, hypertrophic prostate, salivary gland and testis. Data from PCT application WO 98/23435 indicate expression is primarily in bone marrow cell lines, and to a lesser extent, in human endometrial stromal cells, human adult small intestine and human pancreas tumor. PCT application WO 99/14484 reports the fraction of expression in the gastrointestinal system (0.227), reproductive system (0.193), and hematopoietic/immune system (0.168). Finally, this protein is 55% identical and 76% similar to CGI-128 protein, which was isolated from CD34+ cells and is also found in cell lines from the hematopoietic lineage including, HL6 (granulocytic), Jurkat (T-lymphocytic), K562 (erythro-megakaryocytic), and U937 (monocytic).

Supernatant harvested from cells expressing the product of this gene has been shown to increase the permeability of the plasma membrane of renal mesangial cells to calcium. Thus, it is believed that the product of this gene is involved in activating a signal transduction pathway when it binds a receptor on the surface of the plasma membrane of both mesangial cells and other cell types, in addition to other cell-lines or tissue cell types. Thus, polynucleotides and polypeptides have uses, which include, but are not limited to, activating mesangial cells by contacting said cells with a full length polypeptide or a polypeptide fragment which demonstrates this biological activity. Further, the polynucleotides and polypeptides can be used in the methods described in WO9915652, incorporated in its entirety. Binding of a ligand to a receptor is known to alter intracellular levels of small molecules, such as calcium, potassium and sodium, as well as alter pH and membrane potential. Alterations in small molecule concentration can be measured to identify supernatants, which bind to receptors of a particular cell. In addition, when tested against fibroblast cell lines, supernatants removed from cells containing this gene activated the EGR1 (early growth response gene 1) promoter element. Thus, it is likely that this gene activates fibroblast cells through the EGR1 signal transduction pathway. EGR1 is a separate signal transduction pathway from Jak-STAT, genes containing the EGR1 promoter are induced in various tissues and cell types upon activation, leading the cells to undergo differentiation and proliferation (PCT application WO 98/23435)

Polynucleotide comprising sequences encoding the signal peptide of the protein, e.g. VLWLSGLSEPGAA/RQ, can be used in construction of secretion vectors. These vectors would then facilitate the secretion of fusion proteins into the media of cells that have been transfected with the construct of interest. Antibodies which specifically bine the signal peptide could be used to purifiy the fusion protein from the media if desired.

Polynucleotides and polypeptides of the invention are useful as reagents for differential identification of the tissue(s) or cell type(s) present in a biological sample and for diagnosis of diseases and conditions which include, but are not limited to, haemopoietic and gastrointestinal tract disorders and stromatosis, in addition to endothelial, mucosal, or epithelial cell disorders. Similarly, polypeptides and antibodies directed to these polypeptides, are useful in providing immunological probes for differential identification of the tissue(s) or cell type(s). For a number of disorders of the above tissues or cells, particularly of the immune and digestive systems, expression of this gene at significantly higher or lower levels may be routinely detected in certain tissues and cell types (e.g. hemaopoietic, immune, reproductive, gastrointestinal, endocrine, and cancerous and wounded tissues) or bodily fluids (e.g. lymph, serum, plasma, urine, synovial fluid and spinal fluid) or another tissue or cell sample taken from an individual having such a disorder, relative to the standard gene expression level, i.e., the expression level in healthy tissue or bodily fluid from an individual not having the disorder.

The tissue distributioin in bone marrow cells, fetal liver and fetal kidney, combined with the detected calcium flux and EGR1 biological activity, indicates that polynucleotides and polypeptides corresponding to this gene are useful for immune and gastrointestinal tract disorders, and stromatosis, particularly tumors and proliferative disorders. More specifically, polynucleotides and polypeptides corresponding to this gene are useful for the treatment and diagnosis of hematopoietic related disorders such as anemia, pancytopenia, leukopenia, thrombocytopenia or leukemia since stromal cells are important in the production of cells of hematopoietic lineages. The polypeptides and polynucleotides of the invention can be used to enhance hematopoesis as described in WO9831385, incorporated in its entirety. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein as well as, antibodies directed against the protein may show utility as a tumor marker and/or immunotherapy targets for the above listed tissues.

Additionally, since the gene product of 181-16-2-0-A7-CS has been shown to activate the EGR1 promoter element, it likely activates EGR1 signaling activity in fibroblasts. Recent data shows that activation of EGR1 plays a role in wound repair. The cellular transcription factor early growth response factor 1 (Egr1) is expressed minutes after acute injury and serves to stimulate the production of a class of growth factors whose role is to promote tissue repair. Egr-1 expression at the site of dermal wounding in rodents promotes angiogenesis in vitro and in vivo, increases collagen production, and accelerates wound closure. These results show that Egr-1 gene therapy accelerates the normal healing process (Human Gene Ther 2000, vol 11(15):2143–58). Thus, an activator of EGR1 signaling, specifically the gene products of 181-16-2-0-A7-CS (polypeptides and polynucleotides), would be useful in the wound healing process using the methods described in WO9941282 and WO9932135, incorporated by reference in their entireties. Protiens of SEQ ID NO:305 (Internal Designation 187-37-0-0-c10-CS)

The protein of SEQ ID NO:305, encoded by the cDNA of SEQ ID NO:64, is highly expressed in the prostate and brain. The protein of the invention is strongly homologous to the D9 protein, found in both humans (GNP accession number: U95006 and U95007) and in mice (GNP accession number: U95003, U95004, and U95005). D9 is a myeloid precursor protein transcript regulated by the retinoic acid receptor a, hereafter referred to as RAR-α (Scott et al. Blood 1996; 88: 2517–30).

Retinoic acid is the active metabolite of vitamin A, which contributes to a wide range of biological processes such as cellular differentiation, embryogenesis, and tumor suppression. More specifically, retinoic acid stimulates myeloid precursor differentiation into mature granulocytes. For instance, in vitro treatment of acute promyelocytic leukemia blast cells with retinoic acid induces their differentiation (Miyauchi et al. Leuk Lymphoma 1999;33:267–80). In addition, treatment with retinoic acid can induce disease remission in patients affected with promyelocytic leukemia by causing granulocyte precursor differentiation (Slack et al. Ann Hematol 2000;79:227–38).

The diverse range of responses to retinoic acid are mediated by three receptor subtypes: RAR-α, RAR-β, and RAR-γ. RAR-α has been identified as being important for bone marrow maturation of granulocytes (Tsai et al. Genes Dev 1992;6:2258–69). In addition, RAR-α is almost invariably involved in acute promyelocytic leukemia cells by a reciprocal translocation between the long arms of chromosomes 15 and 17 (Alcalay et al., Proc Natl Acad Sci USA 1991;88:1977–81). This type of leukemia is mainly characterized by a predominance of malignant promyelocytes, and severe hemorragic manifestations resulting from activation of the coagulation cascade and the fibrinolytic system (Tallman et al. Semin Thromb Hemost 1999;25:209–15). Reciprocal chromosomal translocation leads to the production of a fusion protein that inhibits differentiation and promotes survival of myeloid precursor cells (Grignani et al. Cell 1993;74, 423–431). Transient transfection of a vector containing RAR-α in a promyelocyte cell line causes upregulation in an early manner of several genes, including D9, which is strongly related to protein of SEQ ID NO:305 (Scott et al. Blood 1996; 88: 2517–30). Thus, it is believed that the protein of SEQ ID NO:305 is a myeloid-related protein whose expression is induced by the activation of retinoic acid receptors, including RAR-α.

In a preferred embodiment, the protein of the invention or part thereof may be used to assay the activity of RAR-α protein or retinoic acid in a biological sample. Specifically, as the expression of the protein is believed to be under the direct control of retinoic acid receptors, the level of the protein of the invention, or of the mRNA encoding the protein, can serve as a sensitive and immediate marker for the effects of retinoic acid upon a cell. An ability to detect retinoic acid receptor activation in cells using the present protein has numerous uses. For instance, the protein of the invention or part thereof can be used to monitor the effects of retinoic acid on cells of a patient undergoing retinoic acid treatment for promyelocytic leukemia (Slack et al. Ann Hematol 2000;79:227–38). As retinoic acid treatment is associated with frequent retarded dose-dependant side effects, it is believed that an assay based on protein of SEQ ID NO:305 could be used to adjust the dose of retinoic acid administered in patients affected with promyelocytic leukemia, in order to predict and avoid such adverse side-effects (Slack et al. Ann Hematol 2000;79:227–38).

In another embodiment, the present polypeptides and polynucleotides can be used to identify myeloid precursors, as well as brain and prostate tissues. The ability to specifically visualize myeloid precursor cells, as well as brain and prostate tissues (and cells derived from the tissues), is useful for any of a number of applications, including to determine the origin or identity of, e.g. cancerous cells, as well as to facilitate the identification of particular cells and tissues for, e.g. the evaluation of histological slides. In addition, such assays can be used to examine the extent of differentiation in myeloid precursor cells.

The present invention further relates to in vitro assays and diagnostic kits based on the protein of the present invention or part thereof. Such assays may be used for diagnosis of disorders where the protein activity is abnormally downregulated, such as cancer, and hematological disorders including leukemia. As the protein of SEQ ID NO:305, RAR-α, and acute promyelocytic leukemia are all related, variation in the measured level of the present protein of the invention or part thereof can be used as a diagnostic or screening test for acute promyelocytic leukemia, e.g. using a biological sample such as serum or plasma. Further, an assay that can detect an abnormal level of the protein of the invention or part thereof can be used to detect residual disease in acute promyelocytic leukemia. Such an assay may be used to aid therapeutic decisions in this disorder, e.g. more or less aggressive treatments, the duration of treatment, etc.

In another embodiment, various methods can be used to modulate activity and/or expression of the protein of SEQ ID NO:305, e.g. for the treatment, attenuation and/or prevention of various disorders. In one embodiment, any of a number of reagents, e.g. polynucleotides encoding the protein of SEQ ID NO:305 or a fragment thereof, the protein of SEQ ID NO:305 itself, or a compound that increased the expression or activity of the protein of SEQ ID NO:305, can be administered to a patient suffering from, or at risk of developing, various disorders including cancer, and hematological diseases such as leukemia, and neutropenia. For instance, but not limited to it, proteins or other capable of enhancing the expression or activity of the protein of SEQ ID NO:305 can be administered to treat patients affected with acute promyelocytic leukemia, in order to induce differentiation of the affected cells into mature granulocytes (Slack et al. Ann Hematol 2000;79:227–38). In still another preferred embodiment, proteins or other compounds capable of increasing the expression or activity of the protein of the invention can be used to treat, prevent and/or attenuate neutropenia or agranulocytosis patients, in order to induce in vivo differentiation of myeloid precursors into mature granulocytes. In still another preferred embodiment, proteins or other compounds capable of increasing the expression or activity of the protein of SEQ ID NO:305 can be used to treat coagulopathic diseases, such as thrombosis or hemorragic manifestations. For instance, they can be used to treat disseminated intravascular coagulation, a severe hemorragic syndrome. This embodiment is supported by the fact that acute promyelocytic leukemia is frequently associated with disseminated intravascular coagulation (Tallman et al. Semin Thromb Hemost 1999;25:209–15), and disseminated intravascular coagulation is efficiently corrected with retinoic acid (Dombret et al. Leukemia 1993;7:2–9).

In addition, modulation of the expression or activity of the protein of the invention can be used to modulate differentiation of cells, e.g. promyelocytic leukemia. In one such embodiment, the protein of the invention is inhibited, e.g. using antisense molecules, antibodies, or small molecule inhibitors of the expression or activity of the protein, in order to maintain the undifferentiated state of cells grown in vitro. Alternatively, agents that increase the expression or activity of the protein in cells can be used to induce cellular differentiation, e.g. in the preparation of specific cell types in vitro for particular therapeutic applications.

Protiens of SEQ ID NO:248 (Internal Designation 105-035-2-0-C6-CS) and SEQ ID NO: 313 (Internal Designation 188-28-4-0-D4-CS)

The proteins of SEQ ID NO:248, encoded by the cDNA of SEQ ID NO: 7, and SEQ ID NO: 313, encoded by the cDNA of SEQ ID NO:72, are highly expressed in brain, liver, pancreas, and testis. The proteins of the invention are nuclear proteins (Miller et al. J Biol Chem 2000;275:32052–6) that display a membrane-spanning segment from amino acids 58 to 78. These proteins are homologous to the human RNA polymerase II elongation factor ELL3 (EMBL accession number AF276512; Miller et al. J Biol Chem. 2000; 275:32052–6). In addition, the proteins of SEQ ID NO:248 and SEQ ID NO:313 share sequence homology with two other members of the polymerase II elongation factor family: ELL, and ELL2. The protein of SEQ ID NO: 313 is similar to the N-terminal sequence the protein of SEQ ID NO:248, but differs after residue 240 because of a frameshift that produces a premature stop in the sequence SEQ ID NO:72 (Miller et al. J Biol Chem 2000; 275:32052–6). Additionally, the alignment of the protein of SEQ ID NO:248 with occludin, an integral membrane protein found at tight junctions (Furuse et al. J Cell Biol 1994; 127:1617–26), reveals that both proteins display a C-terminal ZO-1 binding domain, with a 26% homology over a 108 amino acid segment. Protein SEQ ID NO:313 lacks this domain, as its C-terminal region is truncated as compared to the protein of SEQ ID NO:248. ZO-1 is part of the family of membrane-associated guanylate kinase homologs (MAGUKs) believed to be important in signal transduction originating from sites of cell-cell contact (Willott et al. Proc Natl Acad Sci USA 1993; 90:7834–8).

The proteins of SEQ ID NOs:248 and 313 are RNA polymerase II elongation factors that increase the catalytic rate of transcription elongation, a phase during which RNA polymerase II moves along the DNA and extends the growing RNA chain (Miller et al. J Biol Chem 2000; 275:32052–6). Specifically, the proteins of SEQ ID NOs:248 and 313 suppress transient pausing at multiple sites along the DNA, thereby altering the $K_m$ and/or the $V_{max}$ of the polymerase (Miller et al. J Biol Chem 2000; 275:32052–6). The present proteins belong to a family that is known to include one virally encoded protein (Tat) and six cellular proteins (SIX, P-TEFb, TFIIF, Elongin (SIII), ELL and ELL2).

A growing body of evidence suggests that mis-regulation of elongation may be a key element in a variety of human diseases (see, Aso et al. J Clin Invest 1996; 97:1561–9). For instance, two RNA polymerase II elongation proteins have been implicated in oncogenesis: ELL, which is a frequent target for translocation in acute myeloid leukemia (Thirman et al. Proc Natl Acad Sci USA 1994; 91:12110–4; Mitani et al. Blood 1995;85:2017–24), and elongin, which is a transcription factor regulated by the product of the von Hippel-Lindau tumor suppressor gene, which is itself mutated in the majority of clear-cell renal carcinomas and in families with von Hippel-Lindau disease (Duan et al. Science 1995;269:1402–6, Kibel et al. Science 1995; 269:1444–6).

In addition, overexpression of ELL leads to the transformation of fibroblasts (Kanda et al. J Biol Chem. 1998 27; 273:5248–52). Thus, the proteins of SEQ ID NOs:248 and 313 may be important for oncogenesis of multiple types of neoplastic diseases, especially hematological malignancies.

In one embodiment, the present proteins are used to increase the rate of transcription in vitro. Such an increase can be used for any of the large number of in vitro transcription reactions which are routinely used for molecular biological applications, e.g. for the preparation of RNA, for protein production, for the characterization of promoters and transcription factors, etc.

In another embodiment, the present invention provides diagnostic tools for the detection of mutations in the genes encoding SEQ ID NOs:248 or 313. Such mutations may be detected by a variety of techniques, including RNase and S1 protection assays; alterations in electrophoretic mobility of DNA fragments in gels, with or without denaturing agents such as SSCP or DGGE; dHPLC; and direct DNA sequencing. The detection of mutations in the genes encoding SEQ ID NOs:248 or 313 are useful for the detection of a number of diseases and conditions, such as cancers and hematological malignancies including leukemia. For example, the RNA polymerase II Elongation Factor ELL gene undergoes frequent translocations in acute myeloid leukemia (Thirman et al. Proc Natl Acad Sci USA 1994; 91:12110–4; Mitani et al. Blood 1995; 85:2017–24), and it is likely that other elongation factors are involved in additional such diseases.

Another embodiment of the present inventions relates to compositions and methods for using the proteins or part thereof to specifically visualize myeloid precursor cells, as well as pancreas, liver and testis tissues (and cells derived from the tissues). The ability to detect such cell types is useful for any of a number of applications, including to determine the origin or identity of, e.g. cancerous cells, as well as to facilitate the identification of particular cells and tissues for, e.g. the evaluation of histological slides. In addition, such methods can be used to examine the extent of differentiation in myeloid or myeloid-progenitor cells for staging of leukemia or any other neoplastic disorder. Any method for detecting the presence of the proteins of the invention, or nucleic acids encoding the proteins, can be used, including methods involving the use of antibodies immunospecific for the proteins of invention. Such antibodies can be used in various methods including radioimmunoassays, competitive binding assays, Western Blot analysis and enzyme-linked immunosorbant assay (ELISA) assays, or any other technique known to those skilled in the art. In another embodiment, the present protein or part thereof can be used for the treatment, attenuation and/or prevention of conditions associated with unbalanced amounts and/or activity of the protein of SEQ ID NO:248 or 313. Other modulatory substances can also be used in such embodiments, including chemical compounds such as agonists and antagonists, nucleic acids including antisense and ribozyme sequences, and antibodies. In a preferred embodiment, such substances are employed for the treatment or prevention of certain types of neoplastic disorders associated such as cancer or hematological malignancies such as leukemia. In such embodiments, where an increased level of expression or activity of the present proteins is correlated with the presence of a disease such as cancer, the disease can be treated or prevented using any agent that can provoke a decrease in the level of activity or expression of the protein, such as antibodies, antisense molecules, ribozymes, dominant negative forms of the protein, compounds that inhibit the expression or activity of the proteins, and others. Alternatively, in cases where a decreased level of expression or activity of the proteins is correlated with the presence of a disease such as cancer, the disease can be treated using any agent that can cause an increase in the expression or activity of the protein, such as polynucleotides encoding the proteins, purified forms of the proteins, or any compound that causes an increase in the expression or activity of the proteins. Further, any detection of a correlation between the level of expression or activity of the protein and the presence or absence of a disease can be used to develop diagnostic or screening tools for the detection of the disease itself, or of a predisposition for the disease.

Uses of Antibodies

Antibodies of the present invention have uses that include, but are not limited to, methods known in the art to purify, detect, and target the polypeptides of the present invention including both in vitro and in vivo diagnostic and therapeutic methods. An example of such use using immunoaffinity chromatography is given below. The antibodies of the present invention may be used either alone or in combination with other compositions. For example, the antibodies have use in immunoassays for qualitatively and quantitatively measuring levels of antigen-bearing substances, including the polypeptides of the present invention, in biological samples (See, e.g., Harlow et al., 1988). (Incorporated by reference in the entirety). The antibodies may also be used in therapeutic compositions for killing cells expressing the protein or reducing the levels of the protein in the body.

The invention further relates to antibodies that act as agonists or antagonists of the polypeptides of the present invention. For example, the present invention includes antibodies that disrupt the receptor/ligand interactions with the polypeptides of the invention either partially or fully. Included are both receptor-specific antibodies and ligand-specific antibodies. Included are receptor-specific antibodies, which do not prevent ligand binding but prevent receptor activation. Receptor activation (i.e., signaling) may be determined by techniques described herein or otherwise known in the art. Also include are receptor-specific antibodies which both prevent ligand binding and receptor activation. Likewise, included are neutralizing antibodies that bind the ligand and prevent binding of the ligand to the receptor, as well as antibodies that bind the ligand, thereby preventing receptor activation, but do not prevent the ligand from binding the receptor. Further included are antibodies that activate the receptor. These antibodies may act as agonists for either all or less than all of the biological activities affected by ligand-mediated receptor activation. The antibodies may be specified as agonists or antagonists for biological activities comprising specific activities disclosed herein. The above antibody agonists can be made using methods known in the art. See e.g., WO 96/40281; U.S. Pat. No. 5,811,097; Deng et al. (1998); Chen et al. (1998); Harrop et al. (1998); Zhu et al. (1998); Yoon et al. (1998); Prat et al. (1998); Pitard et al. (1997); Liautard et al. (1997); Carlson et al. (1997); Taryman et al. (1995); Muller et al. (1998); Bartunek et al. (1996) (said references incorporated by reference in their entireties).

As discussed above, antibodies of the polypeptides of the invention can, in turn, be utilized to generate anti-idiotypic antibodies that "mimic" polypeptides of the invention using techniques well known to those skilled in the art (See, e.g. Greenspan and Bona (1989) and Nissinoff (1991), which disclosures are hereby incorporated by reference in their entireties). For example, antibodies which bind to and competitively inhibit polypeptide multimerization or binding of a polypeptide of the invention to ligand can be used to generate anti-idiotypes that "mimic" the polypeptide multimerization or binding domain and, as a consequence, bind to and neutralize polypeptide or its ligand. Such neutralization anti-idiotypic antibodies can be used to bind a polypeptide of the invention or to bind its ligands/receptors, and thereby block its biological activity.

Immunoaffinity Chromatography

Antibodies prepared as described herein are coupled to a support. Preferably, the antibodies are monoclonal antibodies, but polyclonal antibodies may also be used. The support may be any of those typically employed in immunoaffinity chromatography, including Sepharose CL-4B (Pharmacia, Piscataway, N.J.), Sepharose CL-2B (Pharmacia, Piscataway, N.J.), Affi-gel 10 (Biorad, Richmond, Calif.), or glass beads.

The antibodies may be coupled to the support using any of the coupling reagents typically used in immunoaffinity chromatography, including cyanogen bromide. After coupling the antibody to the support, the support is contacted with a sample which contains a target polypeptide whose isolation, purification or enrichment is desired. The target polypeptide may be a polypeptide selected from the group consisting of sequences of SEQ ID Nos: 242–482, mature polypeptides included in SEQ ID Nos: 242–272 and 274–384 as well as full-length and mature polypeptides encoded by the clone inserts of the deposited clone pool, variants and fragments thereof, or a fusion protein comprising said selected polypeptide or a fragment thereof.

Preferably, the sample is placed in contact with the support for a sufficient amount of time and under appropriate conditions to allow at least 50% of the target polypeptide to specifically bind to the antibody coupled to the support.

Thereafter, the support is washed with an appropriate wash solution to remove polypeptides which have non-specifically adhered to the support. The wash solution may be any of those typically employed in immunoaffinity chromatography, including PBS, Tris-lithium chloride buffer (0.1M lysine base and 0.5M lithium chloride, pH 8.0), Tris-hydrochloride buffer (0.05M Tris-hydrochloride, pH 8.0), or Tris/Triton/NaCl buffer (50 mM Tris.cl, pH 8.0 or 9.0, 0.1% Triton X-100, and 0.5MNaCl).

After washing, the specifically bound target polypeptide is eluted from the support using the high pH or low pH elution solutions typically employed in immunoaffinity chromatography. In particular, the elution solutions may contain an eluant such as triethanolamine, diethylamine, calcium chloride, sodium thiocyanate, potasssium bromide, acetic acid, or glycine. In some embodiments, the elution solution may also contain a detergent such as Triton X-100 or octyl-beta-D-glucoside.

Import Vectors

The GENSET polypeptides of the invention may also be used as a carrier to import a protein or peptide of interest, so-called cargo, into tissue-culture cells or in host organisms. A hydrophobic region of a GENSET polypeptide or a fragment thereof, preferably the signal peptide of a sequence selected from the group consisting of of SEQ ID Nos: 1–31 and 33–143 and clones inserts of the deposited clone pool, more preferably the short core hydrophobic region (h) of signal peptides may be used as a carrier.

When cell permeable peptides of limited size (approximately up to 25 amino acids) are to be translocated across cell membrane, chemical synthesis may be used in order to add the h region to either the C-terminus or the N-terminus to the cargo peptide of interest. Alternatively, when longer peptides or proteins are to be imported into cells, nucleic acids can be genetically engineered, using techniques familiar to those skilled in the art, in order to link the cDNA sequence or fragment thereof encoding the hydrophobic region to the 5' or the 3' end of a DNA sequence coding for a cargo polypeptide. Such genetically engineered nucleic acids are then translated either in vitro or in vivo after transfection into appropriate cells, using conventional techniques to produce the resulting cell permeable polypeptide. Suitable hosts cells are then simply incubated with the cell permeable polypeptide which is then translocated across the membrane.

This method may be applied to study diverse intracellular functions and cellular processes. For instance, it has been used to probe functionally relevant domains of intracellular proteins and to examine protein-protein interactions involved in signal transduction pathways (Lin et al., *J. Biol. Chem.*, 270: 14225–14258 (1995); Lin et al., *J. Biol. Chem.*, 271: 5305–5308 (1996); Rojas et al., *J. Biol. Chem.*, 271: 27456–27461 (1996); Rojas et al., *Nature Biotech.*, 16: 370–375 (1998); Liu et al., *Proc. Natl. Acad. Sci. USA*, 93: 11819–11824 (1996); Rojas et al., *Bioch. Biophys. Res. Commun.*, 34: 675–680 (1997) Du et al., *J. Peptide Res.*, 51: 235–243 (1998)).

Such techniques may be used in cellular therapy to import proteins producing therapeutic effects. For instance, cells isolated from a patient may be treated with imported therapeutic proteins and then re-introduced into the host organism.

Alternatively, the hydrophobic region of signal peptides of the present invention could be used in combination with a nuclear localization signal to deliver nucleic acids into cell nucleus. Such oligonucleotides may be antisense oligonucleotides or oligonucleotides designed to form triple helixes, as described herein, in order to respectively inhibit processing or maturation of a target cellular RNA.

Expression of GENSET Products

Spatial Expression of the GENSET Genes of the Invention

Tissue expression of the cDNAs of the present invention was examined. Table IX list the Genset's libraries of tissues and cell types examined that express the polynucleotides of the present invention. The tissues and cell types examined for polynucleotide expression were: adrenal gland (AG), bone marrow (BM), brain (Br), cancerous proteate (CP), cerebellum (Ce), colon (Co), dystrophic muscle (DM), fetal brain (FB), fetal kidney (FK), fetal liver (FL), heart (He), hypertrophic prostate (HP), kidney (Ki), liver (Li), lung (Lu), lung cells (LC), lymph ganglia (LG), lymphocytes (Ly), muscle (Mu), Ovary (Ov), pancreas (Pa), pituitary gland (PG), placenta (Pl), prostate (Pr), salivary gland (SG), spinal cord (SC), spleen (Sp), stomach/intestine (SI), substantia nigra (SN), testis (Te), thyroid (Ty), umbilical cord (UC) and uterus (Ut).

For each cDNA referred to by its sequence identification number (first column), the number of proprietary 5'ESTs (i.e. cDNA fragments) expressed in a particular tissue referred to by its name is indicated after a semi column (second column). In addition, the bias in the spatial distribution of the polynucleotide sequences of the present invention was examined by comparing the relative proportions of the biological polynucleotides of a given tissue using the following statistical analysis. The under- or overrepresentation of a polynucleotide of a given cluster in a given tissue was performed using the normal approximation of the binomial distribution. When the observed proportion of a polynucleotide of a given tissue in a given consensus had less than 1% chance to occur randomly according to the chi2 test, the frequency bias was reported as "preferred".

The results are given in Table X as follows. For each polynucleotide showing a bias in tissue distribution as referred to by its sequence identification number in the first column, the list of tissues where the polynucleotides are under-represented is given in the second column entitled "low frequency expression" and the list of tissues where the polynucleotides are over-represented is given in the third column entitled "high frequency expression".

The cellular localization of some polypeptides of the invention was also determined using the "psort software" (Nakai, and Horton, (1999); Nakai and Kanehisa, (1992), which disclosures are hereby incorporated by reference in their entireties). For each polypeptide identified by its sequence identification number in the first column, the second column of Table XI list the predicted subcellular localization.

Evaluation of Expression Levels and Patterns of GENSET mRNAs

The spatial and temporal expression patterns of GENSET mRNAs, as well as their expression levels, may also be further determined as follows.

Expression levels and patterns of GENSET mRNAs may be analyzed by solution hybridization with long probes as described in International Patent Application No. WO 97/05277, the entire contents of which are hereby incorporated by reference. Briefly, a GENSET polynucleotide, or fragment thereof corresponding to the gene encoding the mRNA to be characterized is inserted at a cloning site immediately downstream of a bacteriophage (T3, T7 or SP6) RNA polymerase promoter to produce antisense RNA. Preferably, the GENSET polynucleotide is at least a 100 nucleotides in length. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridizations are performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

The GENSET cDNAs, or fragments thereof may also be tagged with nucleotide sequences for the serial analysis of gene expression (SAGE) as disclosed in UK Patent Application No. 2 305 241 A, the entire contents of which are incorporated by reference. In this method, cDNAs are prepared from a cell, tissue, organism or other source of nucleic acid for which it is desired to determine gene expression patterns. The resulting cDNAs are separated into two pools. The cDNAs in each pool are cleaved with a first restriction endonuclease, called an "anchoring enzyme," having a recognition site which is likely to be present at least once in most cDNAs. The fragments which contain the 5' or 3' most region of the cleaved cDNA are isolated by binding to a capture medium such as streptavidin coated beads. A first oligonucleotide linker having a first sequence for hybridization of an amplification primer and an internal restriction site for a "tagging endonuclease" is ligated to the digested cDNAs in the first pool. Digestion with the second endonuclease produces short "tag" fragments from the cDNAs. A second oligonucleotide having a second sequence for hybridization of an amplification primer and an internal restriction site is ligated to the digested cDNAs in the second pool. The cDNA fragments in the second pool are also digested with the "tagging endonuclease" to generate short "tag" fragments derived from the cDNAs in the second pool. The "tags" resulting from digestion of the first and second pools with the anchoring enzyme and the tagging endonuclease are ligated to one another to produce "ditags." In some embodiments, the ditags are concatamerized to produce ligation products containing from 2 to 200 ditags. The tag sequences are then determined and compared to the sequences of the GENSET cDNAs to determine which genes are expressed in the cell, tissue, organism, or other source of nucleic acids from which the tags were derived. In this way, the expression pattern of a GENSET gene in the cell, tissue, organism, or other source of nucleic acids is obtained.

Quantitative analysis of GENSET gene expression may also be performed using arrays. For example, quantitative analysis of gene expression may be performed with GENSET polynucleotides, or fragments thereof in a complementary DNA microarray as described by Schena et al. (1995 and 1996) which disclosures are hereby incorporated by reference in their entireties. GENSET cDNAs or fragments thereof are amplified by PCR and arrayed from 96-well microtiter plates onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C. Cell or tissue mRNA is isolated or commercially obtained and probes are prepared by a single round of reverse transcription. Probes are hybridized to 1 cm$^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of the expression of genes may also be performed with GENSET cDNAs or fragments thereof in complementary DNA arrays as described by Pietu et al. (1996), which disclosure is hereby incorporated by reference in its entirety. The GENSET polynucleotides of the invention or fragments thereof are PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis of GENSET genes can be done through high density nucleotide arrays as described by Lockhart et al. (1996) and Sosnowski et al. (1997), which disclosures are hereby incorporated by reference in their entireties. Oligonucleotides of 15–50 nucleotides corresponding to sequences of a GENSET polynucleotide or fragments thereof are synthesized directly on the chip (Lockhart et al., supra) or synthesized and then addressed to the chip (Sosnowski et al., supra). Preferably, the oligonucleotides are about 20 nucleotides in length. cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al., (supra) and application of different electric fields (Sosnowsky et al., supra), the dyes or labeling compounds are detected and quantified. Duplicate hybridizations are performed. Comparative analysis of the intensity of the signal originating from cDNA probes on the same target oligonucleotide in different cDNA samples indicates a differential expression of the GENSET mRNA.

Uses of GENSET Expression Data

Once the expression levels and patterns of a GENSET mRNA has been determined using any technique known to those skilled in the art, in particular those described in the section entitled "Evaluation of Expression Levels and Patterns of GENSET mRNAs", or using the instant disclosure, these information may be used to design GENSET specific markers for detection, identification, screening and diagnosis purposes as well as to design DNA constructs with an expression pattern similar to a GENSET expression pattern.

Detection of GENSET Expression and/or Biological Activity

The invention further relates to methods of detection of GENSET expression and/or biological activity in a biological sample using the polynucleotide and polypeptide sequences described herein. Such method scan be used, for example, as a screen for normal or abnormal GENSET expression and/or biological activity and, thus, can be used diagnostically. The biological sample for use in the methods of the present invention includes a suitable sample from, for example, a mammal, particularly a human. For example, the sample can be issued from tissues or cell lines having the same origin as tissues or cell lines in which the polypeptide is known to be expressed using the data from Table IX.

Detection of GENSET Products

The invention further relates to methods of detection of GENSET polynucleotides or polypeptides in a sample using the sequences described herein and any techniques known to those skilled in the art. For example, a labeled polynucleotide probe having all or a functional portion of the nucleotide sequence of a GENSET polynucleotide can be used in a method to detect a GENSET polynucleotide in a sample. In one embodiment, the sample is treated to render the polynucleotides in the sample available for hybridization to a polynucleotide probe, which can be DNA or RNA. The resulting treated sample is combined with a labeled polynucleotide probe having all or a portion of the nucleotide sequence of the GENSET cDNA or genomic sequence, under conditions appropriate for hybridization of complementary sequences to occur. Detection of hybridization of polynucleotides from the sample with the labeled nucleic probe indicates the presence of GENSET polynucleotides in a sample. The presence of GENSET mRNA is indicative of GENSET expression.

Consequently, the invention comprises methods for detecting the presence of a polynucleotide comprising a nucleotide sequence selected from a group consisting of the sequences of SEQ ID Nos: 1–241, the sequences of clone inserts of the deposited clone pool, sequences fully complementary thereto, fragments and variants thereof in a sample. In a first embodiment, said method comprises the following steps of:

a) bringing into contact said sample and a nucleic acid probe or a plurality of nucleic acid probes which hybridize to said selected nucleotide sequence; and b) detecting the hybrid complex formed between said probe or said plurality of probes and said polynucleotide.

In a preferred embodiment of the above detection method, said nucleic acid probe or said plurality of nucleic acid probes is labeled with a detectable molecule. In another preferred embodiment of the above detection method, said nucleic acid probe or said plurality of nucleic acid probes has been immobilized on a substrate. In still another preferred embodiment, said nucleic acid probe or said plurality of nucleic acid probes has a sequence comprised in a sequence complementary to said selected sequence.

In a second embodiment, said method comprises the following steps of:

a) contacting said sample with amplification reaction reagents comprising a pair of amplification primers located on either side of the region of said nucleotide sequence to be amplified;

b) performing an amplification reaction to synthesize amplification products containing said region of said selected nucleotide sequence; and c) detecting said amplification products.

In a preferred embodiment of the above detection method, when the polynucleotide to be amplified is a RNA molecule, preliminary reverse transcription and synthesis of a second cDNA strand are necessary to provide a DNA template to be amplified. In another preferred embodiment of the above detection method, the amplification product is detected by hybridization with a labeled probe having a sequence which is complementary to the amplified region. In still another preferred embodiment, at least one of said amplification primer has a sequence comprised in said selected sequence or in the sequence complementary to said selected sequence.

Alternatively, a method of detecting GENSET expression in a test sample can be accomplished using any product which binds to a GENSET polypeptide of the present invention or a portion of a GENSET polypeptide. Such products may be antibodies, binding fragments of antibodies, polypeptides able to bind specifically to GENSET polypeptides or fragments thereof, including GENSET agonists and antagonists. Detection of specific binding to the antibody indicates the presence of a GENSET polypeptide in the sample (e.g., ELISA).

Consequently, the invention is also directed to a method for detecting specifically the presence of a GENSET polypeptide according to the invention in a biological sample, said method comprising the following steps of:

a) bringing into contact said biological sample with a product able to bind to a polypeptide of the invention or fragments thereof;

b) allowing said product to bind to said polypeptide to form a complex; and b) detecting said complex.

In a preferred embodiment of the above detection method, the product is an antibody. In a more preferred embodiment, said antibody is labeled with a detectable molecule. In another more preferred embodiment of the above detection method, said antibody has been immobilized on a substrate.

In addition, the invention also relates to methods of determining whether a GENSET product (e.g. a polynucleotide or polypeptide) is present or absent in a biological sample, said methods comprising the steps of:

a) obtaining said biological sample from a human or non-human animal, preferably a mammal;

b) contacting said biological sample with a product able to bind to a GENSET polynucleotide or polypeptide of the invention; and c) determining the presence or absence of said GENSET product in said biological sample.

Compounds that specifically binds a GENSET product may either be compounds binding to a GENSET polypeptide (e.g. binding proteins, antibodies or binding fragments thereof (e.g. F(ab')2 fragments) or compounds bindint to a GENSET polynucleotide (e.g. a complementary probe or primer).

The present invention also relates to kits that can be used in the detection of GENSET expression products. The kit can comprise a compound that specifically binds a GENSET polypeptide (e.g. binding proteins, antibodies or binding fragments thereof (e.g. F(ab')2 fragments) or a GENSET mRNA (e.g. a complementary probe or primer), for example, disposed within a container means. The kit can further comprise ancillary reagents, including buffers and the like.

Detection of a GENSET Biological Activity

The invention further includes methods of detecting specifically a GENSET biological activity. Assessing the GENSET biological activity may be performed using a variety of techniques, including those described in the section entitled "Error! Reference source not found."

Consequently, the invention is directed to a method for detecting specifically GENSET biological activity in a biological sample, said method comprising the following steps:

a) obtaining a biological sample from a human or non-human mammal; and b) detecting a GENSET biological activity.

The present invention also relates to kits that can be used in the detection of GENSET biological activity.

Identification of a Specific Context of GENSET Expression

When the expression pattern of a GENSET mRNA shows that a GENSET gene is specifically expressed in a given context, probes and primers specific for this gene as well as antibodies binding to the GENSET polynucleotide may then be used as markers for a specific context. Examples of specific contexts are: specific expression in a given tissue/cell or tissue/cell type, expression at a given stage of development of a process such as embryo development or disease development, or specific expression in a given organelle. Such primers, probes, and antibodies are useful commercially to identify tissues/cells/organelles of unknown origin, for example, forensic samples, differentiated tumor tissue that has metastasized to foreign bodily sites, or to differentiate different tissue types in a tissue cross-section using any technique known to those skilled in the art including in situ PCR or immunochemistry for example.

For example, the cDNAs and proteins of the sequence listing and fragments thereof, may be used to distinguish human tissues/cells from non-human tissues/cells and to distinguish between human tissues/cells/organelles that do and do not express the polynucleotides comprising the cDNAs. By knowing the expression pattern of a given GENSET, either through routine experimentation or by using the instant disclosure, the polynucleotides and polypeptides of the present invention may be used in methods of determining the identity of an unknown tissue/cell sample/organelle. As part of determining the identity of an unknown tissue/cell sample/organelle, the polynucleotides and polypeptides of the present invention may be used to determine what the unknown tissue/cell sample is and what the unknown sample is not. For example, if a cDNA is expressed in a particular tissue/cell type/organelle, and the unknown tissue/cell sample/organelle does not express the cDNA, it may be inferred that the unknown tissue/cells are either not human or not the same human tissue/cell type/organelle as that which expresses the cDNA. These methods of determining tissue/cell/organelle identity are based on methods which detect the presence or absence of the mRNA (or corresponding cDNA) in a tissue/cell sample using methods well know in the art (e.g., hybridization, PCR based methods, immunoassays, immunochemistry, ELISA). Examples of such techniques are described in more detail below. Therefore, the invention encompasses uses of the polynucleotides and polypeptides of the invention as tissue markers. In a preferred embodiment, polynucleotides preferentially expressed in given tissues as indicated in Table X and polypeptides encoded by such polynucleotides are used for this purpose. The invention also encompasses uses of polypeptides of the invention as organelle markers. In a preferred embodiment, polypeptides preferentially expressed in given subcellular compartment as indicated in Table XI are used for this purpose.

Consequently, the present invention encompasses methods of identification of a tissue/cell type/subcellular compartment, wherein said method includes the steps of:

a) contacting a biological sample which identity is to be assayed with a product able to bind a GENSET product; and b) determining whether a GENSET product is expressed in said biological sample.

Products that are able to bind specifically to a GENSET product, namely a GENSET polypeptide or a GENSET mRNA, include GENSET binding proteins, antibodies or binding fragments thereof (e.g. F(ab')2 fragments), as well as GENSET complementary probes and primers.

Step b) may be performed using any detection method known to those skilled in the art including those disclosed herein, especially in the section entitled "Detection of GENSET expression and/or biological activity".

Identification of Tissue Types or Cell Species by Means of Labeled Tissue Specific Antibodies Identification of specific tissues is accomplished by the visualization of tissue specific antigens by means of antibody preparations which are conjugated, directly (e.g., green fluorescent protein) or indirectly to a detectable marker. Selected labeled antibody species bind to their specific antigen binding partner in tissue sections, cell suspensions, or in extracts of soluble proteins from a tissue sample to provide a pattern for qualitative or semi-qualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation. Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

A. Immunohistochemical Techniques

Purified, high-titer antibodies, prepared as described above, are conjugated to a detectable marker, as described, for example, by Fudenberg, (1980) or Rose et al., (1980), which disclosures are hereby incorporated by reference in their entireties.

A fluorescent marker, either fluorescein or rhodamine, is preferred, but antibodies can also be labeled with an enzyme that supports a color producing reaction with a substrate, such as horseradish peroxidase. Markers can be added to tissue-bound antibody in a second step, as described below. Alternatively, the specific anti-tissue antibodies can be labeled with ferritin or other electron dense particles, and localization of the ferritin coupled antigen-antibody complexes achieved by means of an electron microscope. In yet another approach, the antibodies are radiolabeled, with, for example $^{125}I$, and detected by overlaying the antibody treated preparation with photographic emulsion. Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required. Tissue sections and cell suspensions are prepared for immunohistochemical examination according to common histological techniques. Multiple cryostat sections (about 4 um, unfixed) of the unknown tissue and known control, are mounted and each slide covered with different dilutions of the antibody preparation. Sections of known and unknown tissues should also be treated with preparations to provide a positive control, a negative control, for example, pre-immune sera, and a control for non-specific staining, for example, buffer. Treated sections are incubated in a humid chamber for 30 min at room temperature, rinsed, then washed in buffer for 30–45 min. Excess fluid is blotted away, and the marker developed. If the tissue specific antibody was not labeled in the first incubation, it can be labeled at this time in a second antibody-antibody reaction, for example, by adding fluorescein- or enzyme-conjugated antibody against the immunoglobulin class of the antiserum-producing species, for example, fluorescein labeled antibody to mouse IgG. Such labeled sera are commercially available. The antigen found in the tissues by the above procedure can be quantified by measuring the intensity of color or fluorescence on the tissue section, and calibrating that signal using appropriate standards.

B. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection. A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifugation, and the soluble protein-containing fraction concentrated if necessary and reserved for analysis. A sample of the soluble protein solution is resolved into individual protein species by conventional SDS polyacrylamide electrophoresis as described, for example, by Davis et al., Section 19-2 (1986), using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 ul, and containing from about 1 to 100 ug protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis et al., (1986) Section 19-3. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described herein. In this procedure, as in procedure A above, appropriate positive and negative sample and reagent controls are run.

In either procedure A or B, a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody. The visualization of tissue specific antigen binding at levels above those seen in control tissues to one or more tissue specific antibodies, prepared from the gene sequences identified from cDNA sequences, can identify tissues of unknown origin, for example, forensic samples, or differentiated tumor tissue that has metastasized to foreign bodily sites.

Targeting of Compounds to Subcellular Compartments

GENSET Polypeptides expressed in specific cellular compartments/organelels may also be used to target compounds to these compartments/organelles. The invention therefore encompasses uses of polypeptides and polynucleotides of the invention as organelle targeting tools.

In a first embodiment, GENSET polypeptides expressed in mitochondria may be used to target heterologous compounds, either polypeptides or polynucleotides to mitochondria by recombinantly or chemically fusing a fragment of the protein of the invention to an heterologous polypeptide or polynucleotide. Preferred fragments are signal peptide, amphiphilic alpha helices and/or any other fragments of the protein of the invention, or part thereof, that may contain targeting signals for mitochondria including but not limited to matrix targeting signals as defined in Herrman and Neupert, (2000); Bhagwat et al. (1999), Murphy (1997); Glaser et al. (1998); Ciminale et al. (1999), which disclosures are hereby incorporated by reference in their entireties. Such heterologous compounds may be used to modulate mitochondria's activities. For example, they may be used to induce and/or prevent mitochondrial-induced apoptosis or necrosis. In addition, heterologous polynucleotides may be used for mitochondrial gene therapy to replace a defective mitochondrial gene and/or to inhibit the deleterious expression of a mitochondrial gene.

In a second embodiment, GENSET polypeptides expressed in the endoplasmic reticulum may be used to target heterologous polypeptides to the endoplasmic reticulum by recombinantly or chemically fusing a fragment of the proteins of the invention to an heterologous polypeptide. Preferred fragments are any fragments of the proteins of the invention, or part thereof that may contain targeting signals for the endoplasmic reticulum such as those described in Pidoux and Armstrong (1992), Munro and Pelham (1987); Pelham (1990), which disclosures are hereby incorporated by reference in their entireties.

In a third embodiment, GENSET polypeptides expressed in the nucleus may be used to target heterologous polypeptides or polynucleotides to the nucleus by recombinantly or chemically fusing a fragment of the proteins or polynuleotide of the invention to an heterologous polypeptide or polynucleotide. Preferred fragments are any fragments of the proteins or polynuclotide of the invention, or part thereof, that may contain targeting signals for the nucleus (nuclear localization signals) such as those described in Christophe et al. (2000), which disclosure is hereby incorporated by reference in its entirety.

In a fourth embodiment, GENSET polypeptides expressed in the nucleus may be used to target heterologous polypeptides to the Golgi apparatus by recombinantly or chemically fusing a fragment of the protein of the invention to an heterologous polypeptide. Preferred fragments are signal peptide, transmembrane domains, tyrosine containing regions and/or any other fragments of the proteins of the invention, or part thereof, that may contain (1) targeting signals for the Golgi apparatus such as the ones described in Ugur and Jones, (2000); Picetti and Borrelli, (2000), (2) tyrosine-based Golgi targeting signal region (Zhan et al., (1998); Watson and Pessin (2000); Ward and Moss (2000), or (3) any other region as defined in Munro, (1998); Luetterforst et al., (1999); Essl et al., (1999), which disclosures are hereby incorporated by reference in their entireties.

Screening and Diagnosis of Abnormal GENSET Expression and/or Biological Activity Moreover, antibodies and/or primers specific for GENSET expression may also be used to identify abnormal GENSET expression and/or biological activity, and subsequently to screen and/or diagnose disorders associated with abnormal GENSET expression. For example, a particular disease may result from lack of expression, over expression, or under expression of a GENSET mRNA. By comparing mRNA expression patterns and quantities in samples taken from healthy individuals with those from individuals suffering from a particular disorder, genes responsible for this disorder may be identified. Primers, probes and antibodies specific for this GENSET may then be used to elaborate kits of screening and diagnosis for a disorder in which the gene of interest is specifically expressed or in which its expression is specifically dysregulated, i.e. underexpressed or overexpressed.

Screening for Specific Disorders

The present invention also relates to methods of identifying individuals having elevated or reduced levels of GENSET, which individuals are likely to benefit from therapies to suppress or enhance GENSET expression, respectively. One example of such methods comprises the steps of:

a) obtaining from a human or non-human mammal a biological sample;

b) detecting the presence in said sample of a GENSET product (mRNA or protein) using any method known to those skilled in the art including those described herein, especially at the section entitled "Detection of GENSET products";

c) comparing the amount of said GENSET product present in said sample with that of a control sample; and d) determing whether said human or non-human mammal has a reduced or elevated level of GENSET expression compared to the control sample.

Such individuals with reduced or elevated levels of GENSET products may be predisposed to disorders associated with dyregulation of GENSET gene expression and thus would be candidates for therapies. The identification of elevated levels of GENSET in a patient would be indicative of an individual that would benefit from treatment with agents that suppress GENSET expression or activity. The identification of low levels of GENSET in a patient would be indicative of an individual that would benefit from agents that induce GENSET expression or activity.

Biological samples suitable for use in this method include biological fluids such as blood, lymph, saliva, sperm, maternal milk, and tissue samples (e.g. biopsies) as well as cell cultures or cell extracts derived, for example, from tissue biopsies. The detection step of the present method can be performed using standard protocols for protein/mRNA detection. Examples of suitable protocols include Northern blot analysis, immunoassays (e.g. RIA, Western blots, immunohistochemical analyses), and PCR.

Thus, the present invention further relates to methods of identifying individuals or non-human animals at increased risk for developing, or present state of having, certain diseases/disorders associated with GENSET abnormal expression or biological activity. One example of such methods comprises the steps of:

a) obtaining from a human or non-human mammal a biological sample;

b) detecting the presence or absence in said sample of a GENSET product (mRNA or protein);

c) comparing the amount of said GENSET product present in said sample with that of a control sample; and d) determing whether said human or non-human mammal is at increased risk for developing, or present state of having, a diseases or disorder.

In accordance with this method, the presence in the sample of altered levels of GENSET product indicates that the subject is predisposed to the above-indicated diseases/disorders. Biological samples suitable for use in this method include biological fluids such as blood, lymph, saliva, sperm, maternal milk, and tissue samples (e.g. biopsies.

The diagnostic methodologies described herein are applicable to both humans and non-human mammals.

Detection of GENSET Mutations

The invention also encompasses methods to detect mutations in GENSET polynucleotides of the invention. Such methods may advantageously be used to detect mutations occurring in GENSET genes and preferably in their regulatory regions. When the mutation was proven to be associated with a disease, screening for such mutations may be used for screening and diagnosis purposes.

In one embodiment of the oligonucleotide arrays of the invention, an oligonucleotide probe matrix may advantageously be used to detect mutations occurring in GENSET genes and preferably in their regulatory regions. For this particular purpose, probes are specifically designed to have a nucleotide sequence allowing their hybridization to the genes that carry known mutations (either by deletion, insertion or substitution of one or several nucleotides). By known mutations, it is meant, mutations on the GENSET genes that have been identified according, for example to the technique used by Huang et al. (1996) or Samson et al. (1996), which disclosures are hereby incorporated by reference in their entireties.

Another technique that is used to detect mutations in GENSET genes is the use of a high-density DNA array. Each oligonucleotide probe constituting a unit element of the high density DNA array is designed to match a specific subsequence of a GENSET genomic DNA or cDNA. Thus, an array consisting of oligonucleotides complementary to subsequences of the target gene sequence is used to determine the identity of the target sequence with the wild gene sequence, measure its amount, and detect differences between the target sequence and the reference wild gene sequence of the GENSET gene. In one such design, termed 4L tiled array, is implemented a set of four probes (A, C, G, T), preferably 15-nucleotide oligomers. In each set of four probes, the perfect complement will hybridize more strongly than mismatched probes. Consequently, a nucleic acid target of length L is scanned for mutations with a tiled array containing 4L probes, the whole probe set containing all the possible mutations in the known wild reference sequence. The hybridization signals of the 15-mer probe set tiled array are perturbed by a single base change in the target sequence. As a consequence, there is a characteristic loss of signal or a "footprint" for the probes flanking a mutation position. This technique was described by Chee et al. in 1996, which disclosure is hereby incorporated by reference in its entirety.

Construction of DNA Constructs with a GENSET Expression Pattern

In addition, characterization of the spatial and temporal expression patterns and expression levels of GENSET mRNAs is also useful for constructing expression vectors capable of producing a desired level of gene product in a desired spatial or temporal manner, as discussed below.

DNA Construct That Enables Directing Temporal And Spatial GENSET Gene Expression In Recombinant Cell Hosts And In Transgenic Animals.

In order to study the physiological and phenotypic consequences of a lack of synthesis of a GENSET protein, both at the cell level and at the multi cellular organism level, the invention also encompasses DNA constructs and recombinant vectors enabling a conditional expression of a specific allele of a GENSET genomic sequence or cDNA and also of a copy of this genomic sequence or cDNA harboring substitutions, deletions, or additions of one or more bases as regards to a nucleotide sequence selected from the group consisting of sequences of SEQ ID Nos 1–241 and sequences of clone inserts of the deposited clone pool, or a fragment thereof, these base substitutions, deletions or additions being located either in an exon, an intron or a regulatory sequence, but preferably in the 5'-regulatory sequence or in an exon of the GENSET genomic sequence or within the GENSET cDNA.

A first preferred DNA construct is based on the tetracycline resistance operon tet from *E. coli* transposon Tn10 for controlling the GENSET gene expression, such as described by Gossen et al. (1992, 1995) and Furth et al. (1994), which disclosures are hereby incorporated by reference in their entireties. Such a DNA construct contains seven tet operator sequences from Tn10 (tetop) that are fused to either a minimal promoter or a 5'-regulatory sequence of the GENSET gene, said minimal promoter or said GENSET regulatory sequence being operably linked to a polynucleotide of interest that codes either for a sense or an antisense oligonucleotide or for a polypeptide, including a GENSET polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused o the activating domain of viral protein VP16 of herpes simplex virus, placed under the control of a promoter, such as the HCM-VIE1 enhancer/promoter or the MMTV-LTR. Indeed, a preferred DNA construct of the invention comprise both the polynucleotide containing the tet operator sequences and the polynucleotide containing a sequence coding for the tTA or the rTA repressor. In a specific embodiment, the conditional expression DNA construct contains the sequence encoding the mutant tetracycline repressor rTA, the expression of the polynucleotide of interest is silent in the absence of tetracycline and induced in its presence.

DNA Constructs Allowing Homologous Recombination: Replacement Vectors

A second preferred DNA construct will comprise, from 5'-end to 3'-end: (a) a first nucleotide sequence that is comprised in the GENSET genomic sequence; (b) a nucleotide sequence comprising a positive selection marker, such as the marker for neomycine resistance (neo); and (c) a second nucleotide sequence that is comprised in the GENSET genomic sequence, and is located on the genome downstream the first GENSET nucleotide sequence (a).

In a preferred embodiment, this DNA construct also comprises a negative selection marker located upstream the nucleotide sequence (a) or downstream the nucleotide sequence (c). Preferably, the negative selection marker comprises the thymidine kinase (tk) gene (Thomas et al., 1986), the hygromycine beta gene (Te Riele et al., 1990), the hprt gene (Van der Lugt et al., 1991; Reid et al., 1990) or the Diphteria toxin A fragment (Dt-A) gene (Nada et al., 1993; Yagi et al. 1990), which disclosures are hereby incorporated by reference in their entireties. Preferably, the positive selection marker is located within a GENSET exon sequence so as to interrupt the sequence encoding a GENSET protein. These replacement vectors are described, for example, by Thomas et al. (1986; 1987), Mansour et al. (1988) and Koller et al. (1992).

The first and second nucleotide sequences (a) and (c) may be indifferently located within a GENSET regulatory sequence, an intronic sequence, an exon sequence or a sequence containing both regulatory and/or intronic and/or exon sequences. The size of the nucleotide sequences (a) and (c) ranges from 1 to 50 kb, preferably from 1 to 10 kb, more preferably from 2 to 6 kb and most preferably from 2 to 4 kb.

DNA Constructs Allowing Homologous Recombination: Cre-LoxP System.

These new DNA constructs make use of the site specific recombination system of the P1 phage. The P1 phage possesses a recombinase called Cre which interacts specifically with a 34 base pairs loxP site. The loxP site is composed of two palindromic sequences of 13 bp separated by a 8 bp conserved sequence (Hoess et al., 1986), which disclosure is hereby incorporated by reference in its entirety. The recombination by the Cre enzyme between two loxP sites having an identical orientation leads to the deletion of the DNA fragment.

The Cre-loxP system used in combination with a homologous recombination technique has been first described by Gu et al. (1993, 1994), which disclosures are hereby incorporated by reference in their entireties. Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant cell host. The recombinase enzyme may be brought at the desired time either by (a) incubating the recombinant cell hosts in a culture medium containing this enzyme, by injecting the Cre enzyme directly into the desired cell, such as described by Araki et al. (1995), which disclosure is hereby incorporated by reference in its entirety, or by lipofection of the enzyme into the cells, such as described by Baubonis et al. (1993), which disclosure is hereby incorporated by reference in its entirety; (b) transfecting the cell host with a vector comprising the Cre coding sequence operably linked to a promoter functional in the recombinant cell host, which promoter being optionally inducible, said vector being introduced in the recombinant cell host, such as described by Gu et al. (1993) and Sauer et al. (1988), which disclosures are hereby incorporated by reference in their entireties; (c) introducing in the genome of the cell host a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu et al. (1994).

In a specific embodiment, the vector containing the sequence to be inserted in the GENSET gene by homologous recombination is constructed in such a way that selectable markers are flanked by loxP sites of the same orientation, it is possible, by treatment by the Cre enzyme, to eliminate the selectable markers while leaving the GENSET sequences of interest that have been inserted by an homologous recombination event. Again, two selectable markers are needed: a positive selection marker to select for the recombination event and a negative selection marker to select for the homologous recombination event. Vectors and methods using the Cre-loxP system are described by Zou et al. (1994), which disclosure is hereby incorporated by reference in its entirety.

Thus, a third preferred DNA construct of the invention comprises, from 5'-end to 3'-end: (a) a first nucleotide sequence that is comprised in the GENSET genomic sequence; (b) a nucleotide sequence comprising a polynucleotide encoding a positive selection marker, said nucleotide sequence comprising additionally two sequences defining a site recognized by a recombinase, such as a loxP site, the two sites being placed in the same orientation; and (c) a second nucleotide sequence that is comprised in the GENSET genomic sequence, and is located on the genome downstream of the first GENSET nucleotide sequence (a).

The sequences defining a site recognized by a recombinase, such as a loxP site, are preferably located within the nucleotide sequence (b) at suitable locations bordering the nucleotide sequence for which the conditional excision is sought. In one specific embodiment, two loxP sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant host cell of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu et al. (1994).

The presence of the Cre enzyme within the genome of the recombinant cell host may result from the breeding of two transgenic animals, the first transgenic animal bearing the GENSET-derived sequence of interest containing the loxP sites as described above and the second transgenic animal bearing the Cre coding sequence operably linked to a suitable promoter sequence, such as described by Gu et al. (1994).

Spatio-temporal control of the Cre enzyme expression may also be achieved with an adenovirus based vector that contains the Cre gene thus allowing infection of cells, or in vivo infection of organs, for delivery of the Cre enzyme, such as described by Anton and Graham (1995) and Kanegae et al. (1995), which disclosures are hereby incorporated by reference in their entireties.

The DNA constructs described above may be used to introduce a desired nucleotide sequence of the invention, preferably a GENSET genomic sequence or a GENSET cDNA sequence, and most preferably an altered copy of a GENSET genomic or cDNA sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination).

Modifying GENSET Expression and/or Biological Activity

Modifying endogenous GENSET expression and/or biological activity is expressly contemplated by the present invention.

Screening for Compounds that Modulate GENSET Expression and/or Biological Activity The present invention further relates to compounds able to modulate GENSET expression and/or biological activity and methods to use these compounds. Such compounds may interact with the regulatory sequences of GENSET genes or they may interact with GENSET polypeptides directly or indirectly.

Compounds Interacting with GENSET Regulatory Sequences

The present invention also concerns a method for screening substances or molecules that are able to interact with the regulatory sequences of a GENSET gene, such as for example promoter or enhancer sequences in untranscribed regions of the genomic DNA, as determined using any techniques known to those skilled in the art including those described in the section entitled "Identification of Promoters in Cloned Upstream Sequences, or such as regulatory sequences located in untranslated regions of GENSET mRNA.

Sequences within untranscribed or untranslated regions of polynucleotides of the invention may be identified by comparison to databases containing known regulatory sequence such as transcription start sites, transcription factor binding sites, promoter sequences, enhancer sequences, 5'UTR and 3'UTR elements (Pesole et al., 2000; http://igs-server.cnrs-mrs.fr/~gauthere/UTR/index.html). Alternatively, the regulatory sequences of interest may be identified through conventional mutagenesis or deletion analyses of reporter plasmids using, for instance, techniques described in the section entitled "Identification of Promoters in Cloned Upstream Sequences".

Following the identification of potential GENSET regulatory sequences, proteins which interact with these regulatory sequences may be identified as described below.

Gel retardation assays may be performed independently in order to screen candidate molecules that are able to interact with the regulatory sequences of the GENSET gene, such as described by Fried and Crothers (1981), Garner and Revzin (1981) and Dent and Latchman (1993), the teachings of these publications being herein incorporated by reference. These techniques are based on the principle according to which a DNA or mRNA fragment which is bound to a protein migrates slower than the same unbound DNA or mRNA fragment. Briefly, the target nucleotide sequence is labeled. Then the labeled target nucleotide sequence is brought into contact with either a total nuclear extract from cells containing regulation factors, or with different candidate molecules to be tested. The interaction between the target regulatory sequence of the GENSET gene and the candidate molecule or the regulation factor is detected after gel or capillary electrophoresis through a retardation in the migration.

Nucleic acids encoding proteins which are able to interact with the promoter sequence of the GENSET gene, more particularly a nucleotide sequence selected from the group consisting of the polynucleotides of the 5' and 3' regulatory region or a fragment or variant thereof, may be identified by using a one-hybrid system, such as that described in the booklet enclosed in the Matchmaker One-Hybrid System kit from Clontech (Catalog Ref. n° K1603-1), the technical teachings of which are herein incorporated by reference. Briefly, the target nucleotide sequence is cloned upstream of a selectable reporter sequence and the resulting polynucleotide construct is integrated in the yeast genome (*Saccharomyces cerevisiae*). Preferably, multiple copies of the target sequences are inserted into the reporter plasmid in tandem. The yeast cells containing the reporter sequence in their genome are then transformed with a library comprising fusion molecules between cDNAs encoding candidate proteins for binding onto the regulatory sequences of the GENSET gene and sequences encoding the activator domain of a yeast transcription factor such as GAL4. The recombinant yeast cells are plated in a culture broth for selecting cells expressing the reporter sequence. The recombinant yeast cells thus selected contain a fusion protein that is able to bind onto the target regulatory sequence of the GENSET gene. Then, the cDNAs encoding the fusion proteins are sequenced and may be cloned into expression or transcription vectors in vitro. The binding of the encoded polypeptides to the target regulatory sequences of the GENSET gene may be confirmed by techniques familiar to the one skilled in the art, such as gel retardation assays or DNAse protection assays.

Ligands Interacting with GENSET Polypeptides

For the purpose of the present invention, a ligand means a molecule, such as a protein, a peptide, an antibody or any synthetic chemical compound capable of binding to a GENSET protein or one of its fragments or variants or to modulate the expression of the polynucleotide coding for GENSET or a fragment or variant thereof.

In the ligand screening method according to the present invention, a biological sample or a defined molecule to be tested as a putative ligand of a GENSET protein is brought into contact with the corresponding purified GENSET protein, for example the corresponding purified recombinant GENSET protein produced by a recombinant cell host as described herein, in order to form a complex between this protein and the putative ligand molecule to be tested.

As an illustrative example, to study the interaction of a GENSET protein, or a fragment comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274-384 as well as full-length and mature polypeptides encoded by the clone inserts of the deposited clone pool, with drugs or small molecules, such as molecules generated through combinatorial chemistry approaches, the microdialysis coupled to HPLC method described by Wang et al. (1997) or the affinity capillary electrophoresis method described by Bush et al. (1997), the disclosures of which are incorporated by reference, can be used.

In further methods, peptides, drugs, fatty acids, lipoproteins, or small molecules which interact with a GENSET protein, or a fragment comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274-384, as well as full-length and mature polypeptides encoded by the clone inserts of the deposited clone pool may be identified using assays such as the following. The molecule to be tested for binding is labeled with a detectable label, such as a fluorescent, radioactive, or enzymatic tag and placed in contact with immobilized GENSET protein, or a fragment thereof under conditions which permit specific binding to occur. After removal of non-specifically bound molecules, bound molecules are detected using appropriate means.

Various candidate substances or molecules can be assayed for interaction with a GENSET polypeptide. These substances or molecules include, without being limited to, natural or synthetic organic compounds or molecules of biological origin such as polypeptides. When the candidate substance or molecule comprises a polypeptide, this polypeptide may be the resulting expression product of a phage clone belonging to a phage-based random peptide library, or alternatively the polypeptide may be the resulting expression product of a cDNA library cloned in a vector suitable for performing a two-hybrid screening assay.

A. Candidate Ligands Obtained from Random Peptide Libraries

In a particular embodiment of the screening method, the putative ligand is the expression product of a DNA insert contained in a phage vector (Parmley and Smith, 1988). Specifically, random peptide phages libraries are used. The random DNA inserts encode for peptides of 8 to 20 amino acids in length (Oldenburg et al., 1992; Valadon et al., 1996; Lucas, 1994; Westerink, 1995; Felici et al., 1991), which disclosures are hereby incorporated by reference in their entireties. According to this particular embodiment, the recombinant phages expressing a protein that binds to an immobilized GENSET protein is retained and the complex formed between the GENSET protein and the recombinant phage may be subsequently immunoprecipitated by a polyclonal or a monoclonal antibody directed against the GENSET protein.

Once the ligand library in recombinant phages has been constructed, the phage population is brought into contact with the immobilized GENSET protein. Then the preparation of complexes is washed in order to remove the non-specifically bound recombinant phages. The phages that bind specifically to the GENSET protein are then eluted by a buffer (acid pH) or immunoprecipitated by the monoclonal antibody produced by the hybridoma anti-GENSET, and this phage population is subsequently amplified by an over-infection of bacteria (for example E. coli). The selection step may be repeated several times, preferably 2–4 times, in order to select the more specific recombinant phage clones. The last step comprises characterizing the peptide produced by the selected recombinant phage clones either by expression in infected bacteria and isolation, expressing the phage insert in another host-vector system, or sequencing the insert contained in the selected recombinant phages.

B. Candidate Ligands Obtained by Competition Experiments.

Alternatively, peptides, drugs or small molecules which bind to a GENSET protein or fragment thereof comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384, as well as full-length and mature polypeptides encoded by the clone inserts of the deposited clone pool, may be identified in competition experiments. In such assays, the GENSET protein, or a fragment thereof, is immobilized to a surface, such as a plastic plate. Increasing amounts of the peptides, drugs or small molecules are placed in contact with the immobilized GENSET protein, or a fragment thereof, in the presence of a detectable labeled known GENSET protein ligand. For example, the GENSET ligand may be detectably labeled with a fluorescent, radioactive, or enzymatic tag. The ability of the test molecule to bind the GENSET protein, or a fragment thereof, is determined by measuring the amount of detectably labeled known ligand bound in the presence of the test molecule. A decrease in the amount of known ligand bound to the GENSET protein, or a fragment thereof, when the test molecule is present indicated that the test molecule is able to bind to the GENSET protein, or a fragment thereof.

C. Candidate Ligands Obtained by Affinity Chromatography.

Proteins or other molecules interacting with a GENSET protein, or a fragment thereof comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384, as well as full-length and mature polypeptides encoded by the clone inserts of the deposited clone pool, can also be found using affinity columns which contain the GENSET protein, or a fragment thereof. The GENSET protein, or a fragment thereof, may be attached to the column using conventional techniques including chemical coupling to a suitable column matrix such as agarose, Affi Gel®, or other matrices familiar to those of skill in art. In some embodiments of this method, the affinity column contains chimeric proteins in which the GENSET protein, or a fragment thereof, is fused to glutathion S transferase (GST). A mixture of cellular proteins or pool of expressed proteins as described above is applied to the affinity column. Proteins or other molecules interacting with the GENSET protein, or a fragment thereof, attached to the column can then be isolated and analyzed on 2-D electrophoresis gel as described in Ramunsen et al. (1997), the disclosure of which is incorporated by reference. Alternatively, the proteins retained on the affinity column can be purified by electrophoresis based methods and sequenced. The same method can be used to isolate antibodies, to screen phage display products, or to screen phage display human antibodies.

D. Candidate Ligands Obtained by Optical Biosensor Methods

Proteins interacting with a GENSET protein, or a fragment comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384, as well as full-length and mature polypeptides encoded by the clone inserts of the deposited clone pool, can also be screened by using an Optical Biosensor as described in Edwards and Leatherbarrow (1997) and also in Szabo et al. (1995), the disclosures of which are incorporated by reference. This technique permits the detection of interactions between molecules in real time, without the need of labeled molecules. This technique is based on the surface plasmon resonance (SPR) phenomenon. Briefly, the candidate ligand molecule to be tested is attached to a surface (such as a carboxymethyl dextran matrix). A light beam is directed towards the side of the surface that does not contain the sample to be tested and is reflected by said surface. The SPR phenomenon causes a decrease in the intensity of the reflected light with a specific association of angle and wavelength. The binding of candidate ligand molecules cause a change in the refraction index on the surface, which change is detected as a change in the SPR signal. For screening of candidate ligand molecules or substances that are able to interact with the GENSET protein, or a fragment thereof, the GENSET protein, or a fragment thereof, is immobilized onto a surface. This surface comprises one side of a cell through which flows the candidate molecule to be assayed. The binding of the candidate molecule on the GENSET protein, or a fragment thereof, is detected as a change of the SPR signal. The candidate molecules tested may be proteins, peptides, carbohydrates, lipids, or small molecules generated by combinatorial chemistry. This technique may also be performed by immobilizing eukaryotic or prokaryotic cells or lipid vesicles exhibiting an endogenous or a recombinantly expressed GENSET protein at their surface.

The main advantage of the method is that it allows the determination of the association rate between the GENSET protein and molecules interacting with the GENSET protein. It is thus possible to select specifically ligand molecules interacting with the GENSET protein, or a fragment thereof, through strong or conversely weak association constants.

E. Candidate Ligands Obtained Through a Two-Hybrid Screening Assay.

The yeast two-hybrid system is designed to study protein-protein interactions in vivo (Fields and Song, 1989), which disclosure is hereby incorporated by reference in its entirety, and relies upon the fusion of a bait protein to the DNA binding domain of the yeast Gal4 protein. This technique is also described in the U.S. Pat. No. 5,667,973 and the U.S. Pat. No. 5,283,173, the technical teachings of both patents being herein incorporated by reference.

The general procedure of library screening by the two-hybrid assay may be performed as described by Harper et al. (1993) or as described by Cho et al. (1998) or also Fromont-Racine et al. (1997), which disclosures are hereby incorporated by reference in their entireties.

The bait protein or polypeptide comprises, consists essentially of, or consists of a GENSET polypeptide or a fragment thereof comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384, as well as full-length and mature polypeptides encoded by the clone inserts of the deposited clone pool.

More precisely, the nucleotide sequence encoding the GENSET polypeptide or a fragment or variant thereof is fused to a polynucleotide encoding the DNA binding domain of the GAL4 protein, the fused nucleotide sequence being inserted in a suitable expression vector, for example pAS2 or pM3.

Then, a human cDNA library is constructed in a specially designed vector, such that the human cDNA insert is fused to a nucleotide sequence in the vector that encodes the transcriptional domain of the GAL4 protein. Preferably, the vector used is the pACT vector. The polypeptides encoded by the nucleotide inserts of the human cDNA library are termed "pray" polypeptides.

A third vector contains a detectable marker gene, such as beta galactosidase gene or CAT gene that is placed under the control of a regulation sequence that is responsive to the binding of a complete Gal4 protein containing both the transcriptional activation domain and the DNA binding domain. For example, the vector pG5EC may be used.

Two different yeast strains are also used. As an illustrative but non limiting example the two different yeast strains may be the followings:

Y190, the phenotype of which is (MATa, Leu2-3, 112 ura3-12, trp1-901, his3-D200, ade2-101, gal4Dgal180D URA3 GAL-LacZ, LYS GAL-HIS3, cyh$^r$);

Y187, the phenotype of which is (MATa gal4 gal80 his3 trp1-901 ade2-101 ura3-52 leu2-3, –112 URA3 GAL-lacZmet$^-$), which is the opposite mating type of Y190.

Briefly, 20 μg of pAS2/GENSET and 20 μg of pACT-cDNA library are co-transformed into yeast strain Y190. The transformants are selected for growth on minimal media lacking histidine, leucine and tryptophan, but containing the histidine synthesis inhibitor 3-AT (50 mM). Positive colonies are screened for beta galactosidase by filter lift assay. The double positive colonies (His$^+$, beta-gal$^+$) are then grown on plates lacking histidine, leucine, but containing tryptophan and cycloheximide (10 mg/ml) to select for loss of pAS2/GENSET plasmids but retention of pACT-cDNA library plasmids. The resulting Y190 strains are mated with Y187 strains expressing GENSET or non-related control proteins; such as cyclophilin B, lamin, or SNF1, as Gal4 fusions as described by Harper et al. (1993) and by Bram et al. (1993), which disclosures are hereby incorporated by reference in their entireties, and screened for beta galactosidase by filter lift assay. Yeast clones that are beta gal-after mating with the control Gal4 fusions are considered false positives.

In another embodiment of the two-hybrid method according to the invention, interaction between the GENSET or a fragment or variant thereof with cellular proteins may be assessed using the Matchmaker Two Hybrid System 2 (Catalog No. K1604-1, Clontech). As described in the manual accompanying the kit, the disclosure of which is incorporated herein by reference, nucleic acids encoding the GENSET protein or a portion thereof, are inserted into an expression vector such that they are in frame with DNA encoding the DNA binding domain of the yeast transcriptional activator GAL4. A desired cDNA, preferably human cDNA, is inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain interaction between GENSET and the protein or peptide encoded by the initially selected cDNA insert.

Compounds Modulating GENSET Biological Activity

Another method of screening for compounds that modulate GENSET gene expression and/or biological activity is by measuring the effects of test compounds on a given cellular property in a host cell, such as apoptosis, proliferation, differentiation, protein glycosylation, etc. . . using a variety of techniques known to those skilled in the art including those described herein and especially in the section entitled "Error! Reference source not found.".

In one embodiment, the present invention relates to a method of identifying an agent which alters GENSET activity, wherein a nucleic acid construct comprising a nucleic acid which encodes a mammalian GENSET polypeptide is introduced into a host cell. The host cells produced are maintained under conditions appropriate for expression of the encoded mammalian GENSET polypeptides, whereby the nucleic acid is expressed. The host cells are then contacted with a compound to be assessed (an agent) and the given cellular property of the cells is detected in the presence of the compound to be assessed. Detection of a change in the given cellular property in the presence of the agent indicates that the agent alters GENSET activity.

In a particular embodiment, the invention relates to a method of identifying an agent which is an activator of GENSET activity, wherein detection of a change of the given cellular property in the presence of the agent indicates that the agent activates GENSET activity. In another particular embodiment, the invention relates to a method of identifying an agent which is an inhibitor of GENSET activity, wherein detection of a change of the given cellular property in the presence of the agent indicates that the agent inhibits GENSET activity.

Methods of Screening for Compounds Modulating GENSET Expression and/or Activity

The present invention also relates to methods of screening compounds for their ability to modulate (e.g. increase or inhibit) the activity or expression of GENSET. More specifically, the present invention relates to methods of testing compounds for their ability either to increase or to decrease expression or activity of GENSET. The assays are performed in vitro or in vivo.

In vitro Methods

In vitro, cells expressing GENSET are incubated in the presence and absence of the test compound. By determining the level of GENSET expression in the presence of the test compound or the level of GENSET activity in the presence of the test compound, compounds can be identified that suppress or enhance GENSET expression or activity. Alternatively, constructs comprising a GENSET regulatory sequence operably linked to a reporter gene (e.g. luciferase, chloramphenicol acetyl transferase, LacZ, green fluorescent protein, etc.) can be introduced into host cells and the effect of the test compounds on expression of the reporter gene detected. Cells suitable for use in the foregoing assays include, but are not limited to, cells having the same origin as tissues or cell lines in which the polypeptide is known to be expressed using the data from Table IX.

Consequently, the present invention encompasses a method for screening molecules that modulate the expression of a GENSET gene, said screening method comprising the steps of:

a) cultivating a prokaryotic or an eukaryotic cell that has been transfected with a nucleotide sequence encoding a GENSET protein or a variant or a fragment thereof, placed under the control of its own promoter;

b) bringing into contact said cultivated cell with a molecule to be tested;

c) quantifying the expression of said GENSET protein or a variant or a fragment thereof in the presence of said molecule.

Using DNA recombination techniques well known by the one skill in the art, the GENSET protein encoding DNA sequence is inserted into an expression vector, downstream from its promoter sequence. As an illustrative example, the promoter sequence of the GENSET gene is contained in the 5' untranscribed region of the GENSET genomic DNA.

The quantification of the expression of a GENSET protein may be realized either at the mRNA level (using for example Northen blots, RT-PCR, preferably quantitative RT-PCR with primers and probes specific for the GENSET mRNA of interest) or at the protein level (using polyclonal or monoclonal antibodies in immunoassays such as ELISA or RIA assays, Western blots, or immunochemistry).

The present invention also concerns a method for screening substances or molecules that are able to increase, or in contrast to decrease, the level of expression of a GENSET gene. Such a method may allow the one skilled in the art to select substances exerting a regulating effect on the expression level of a GENSET gene and which may be useful as active ingredients included in pharmaceutical compositions for treating patients suffering from disorders associated with abnormal levels of GENSET products.

Thus, also part of the present invention is a method for screening a candidate molecule that modulates the expression of a GENSET gene, this method comprises the following steps:

a) providing a recombinant cell host containing a nucleic acid, wherein said nucleic acid comprises a GENSET 5' regulatory region or a regulatory active fragment or variant thereof, operably linked to a polynucleotide encoding a detectable protein;

b) obtaining a candidate molecule; and c) determining the ability of said candidate molecule to modulate the expression levels of said polynucleotide encoding the detectable protein.

In a further embodiment, said nucleic acid comprising a GENSET 5' regulatory region or a regulatory active fragment or variant thereof, includes the 5'UTR region of a GENSET cDNA selected from the group comprising of the 5'UTRs of the sequences of SEQ ID Nos 1–241, sequences of clones inserts of the deposited clone pool, regulatory active fragments and variants thereof. In a more preferred embodiment of the above screening method, said nucleic acid includes a promoter sequence which is endogenous with respect to the GENSET 5'UTR sequence. In another more preferred embodiment of the above screening method, said nucleic acid includes a promoter sequence which is exogenous with respect to the GENSET 5'UTR sequence defined therein.

Preferred polynucleotides encoding a detectable protein are polynucleotides encoding beta galactosidase, green fluorescent protein (GFP) and chloramphenicol acetyl transferase (CAT).

The invention further relates to a method for the production of a pharmaceutical composition comprising a method of screening a candidate molecule that modulates the expression of a GENSET gene and furthermore mixing the identified molecule with a pharmaceutically acceptable carrier.

The invention also pertains to kits for the screening of a candidate substance modulating the expression of a GENSET gene. Preferably, such kits comprise a recombinant vector that allows the expression of a GENSET 5' regulatory region or a regulatory active fragment or a variant thereof, operably linked to a polynucleotide encoding a detectable protein or a GENSET protein or a fragment or a variant thereof More preferably, such kits include a recombinant vector that comprises a nucleic acid including the 5'UTR region of a GENSET cDNA selected from the group comprising the 5'UTRs of the sequences of SEQ ID Nos 1–241, sequences of clones inserts of the deposited clone pool, regulatory active fragments and variants thereof, being operably linked to a polynucleotide encoding a detectable protein.

For the design of suitable recombinant vectors useful for performing the screening methods described above, it will be referred to the section of the present specification wherein the preferred recombinant vectors of the invention are detailed.

Another object of the present invention comprises methods and kits for the screening of candidate substances that interact with a GENSET polypeptide, fragments or variants thereof. By their capacity to bind covalently or non-covalently to a GENSET protein, fragments or variants thereof, these substances or molecules may be advantageously used both in vitro and in vivo.

In vitro, said interacting molecules may be used as detection means in order to identify the presence of a GENSET protein in a sample, preferably a biological sample.

A method for the screening of a candidate substance that interact with a GENSET polypeptide, fragments or variants thereof, said methods comprising the following steps:

a) providing a polypeptide comprising, consisting essentially of, or consisting of a GENSET protein or a fragment comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384 as well as full-length and mature polypeptides encoded by the clone inserts of the deposited clone pool;

b) obtaining a candidate substance;

c) bringing into contact said polypeptide with said candidate substance;

d) detecting the complexes formed between said polypeptide and said candidate substance.

The invention further relates to a method for the production of a pharmaceutical composition comprising a method for the screening of a candidate substance that interact with a GENSET polypeptide, fragments or variants thereof and furthermore mixing the identified substance with a pharmaceutically acceptable carrier.

The invention further concerns a kit for the screening of a candidate substance interacting with the GENSET polypeptide, wherein said kit comprises:

a) a polypeptide comprising, consisting essentially of, or consisting of a GENSET protein or a fragment comprising a contiguous span of at least 6 amino acids, preferably at least 8 to 10 amino acids, more preferably at least 12, 15, 20, 25, 30, 40, 50, or 100 amino acids of a polypeptide selected from the group consisting of sequences of SEQ ID Nos: 242–482, mature polypeptides included in SEQ ID Nos: 242–272 and 274–384 as well as full-length and mature polypeptides encoded by the clone inserts of the deposited clone pool; and b) optionally means useful to detect the complex formed between said polypeptide or a variant thereof and the candidate substance.

In a preferred embodiment of the kit described above, the detection means comprises a monoclonal or polyclonal antibody binding to said GENSET protein or fragment or variant thereof.

In vivo Methods

Compounds that suppress or enhance GENSET expression can also be identified using in vivo screens. In these assays, the test compound is administered (e.g. IV, IP, IM, orally, or otherwise), to the animal, for example, at a variety of dose levels. The effect of the compound on GENSET expression is determined by comparing GENSET levels, for example in tissues known to express the gene of interest using, for example the data obtained in Table IX, and using Northern blots, immunoassays, PCR, etc., as described above. Suitable test animals include rodents (e.g., mice and rats), primates, mammals. Humanized mice can also be used as test animals, that is mice in which the endogenous mouse protein is ablated (knocked out) and the homologous human protein added back by standard transgenic approaches. Such mice express only the human form of a protein. Humanized mice expressing only the human GENSET can be used to study in vivo responses to potential agents regulating GENSET protein or mRNA levels. As an example, transgenic mice have been produced carrying the human apoE4 gene. They are then bred with a mouse line that lacks endogenous apoE, to produce an animal model carrying human proteins believed to be instrumental in development of Alzheimer's pathology. Such transgenic animals are useful for dissecting the biochemical and physiological steps of disease, and for development of therapies for disease intervention (Loring, et al, 1996) (incorporated herein by reference in its entirety).

Uses for Compounds Modulating GENSET Expression and/or Biological Activity

Using in vivo (or in vitro) systems, it may be possible to identify compounds that exert a tissue specific effect, for example, that increase GENSET expression or activity only in tissues of interest. Screening procedures such as those described above are also useful for identifying agents for their potential use in pharmacological intervention strategies. Agents that enhance GENSET expression or stimulate its activity may thus be used to treat disorders which require upregulated levels of GENSET gene expression and/or activity. Compounds that suppress GENSET expression or inhibit its activity can be used to treat disorders which require downregulated levels of GENSET gene expression and/or activity.

Also encompassed by the present invention is an agent which interacts with GENSET directly or indirectly, and inhibits or enhances GENSET expression and/or function. In one embodiment, the agent is an inhibitor which interferes with GENSET directly (e.g., by binding GENSET) or indirectly (e.g., by blocking the ability of GENSET to have a GENSET biological activity). In a particular embodiment, an inhibitor of GENSET protein is an antibody specific for GENSET protein or a functional portion of GENSET; that is, the antibody binds a GENSET polypeptide. For example, the antibody can be specific for a polypeptide encoded by one of the amino acid sequences of human GENSET genes (SEQ ID Nos: 242–482, mature polypeptides included in SEQ ID Nos: 242–272 and 274–384, full-length and mature polypeptides encoded by the clone inserts of the deposited clone pool), mammal GENSET or portions thereof. Alternatively, the inhibitor can be an agent other than an antibody (e.g., small organic molecule, protein or peptide) which binds GENSET and blocks its activity. For example, the inhibitor can be an agent which mimics GENSET structurally, but lacks its function. Alternatively, it can be an agent which binds to or interacts with a molecule which GENSET normally binds with or interacts with, thus blocking GENSET from doing so and preventing it from exerting the effects it would normally exert.

In another embodiment, the agent is an enhancer (activator) of GENSET which increases the activity of GENSET (increases the effect of a given amount or level of GENSET), increases the length of time it is effective (by preventing its degradation or otherwise prolonging the time during which it is active) or both either directly or indirectly.

The GENSET sequences of the present invention can also be used to generate nonhuman gene knockout animals, such as mice, which lack a GENSET gene or transgenically overexpress GENSET. For example, such GENSET gene knockout mice can be generated and used to obtain further insight into the function of GENSET as well as assess the specificity of GENSET activators and inhibitors. Also, over expression of GENSET (e.g., human GENSET) in transgenic mice can be used as a means of creating a test system for GENSET activators and inhibitors (e.g., against human GENSET). In addition, the GENSET gene can be used to clone the GENSET promoter/enhancer in order to identify regulators of GENSET transcription. GENSET gene knockout animals include animals which completely or partially lack the GENSET gene and/or GENSET activity or function. Thus the present invention relates to a method of inhibiting (partially or completely) GENSET biological activty in a mammal (e.g., human) comprising administering to the mammal an effective amount of an inhibitor of GENSET. The invention also relates to a method of enhancing GENSET biological activity in a mammal comprising administering to the mammal an effective amount of an enhancer GENSET.

Inhibiting GENSET Expression

Therapeutic compositions according to the present invention may comprise advantageously one or several GENSET oligonucleotide fragments as an antisense tool or a triple helix tool that inhibits the expression of the corresponding GENSET gene.

Antisense Approach

In antisense approaches, nucleic acid sequences complementary to an mRNA are hybridized to the mRNA intracellularly, thereby blocking the expression of the protein encoded by the mRNA. The antisense nucleic acid molecules to be used in gene therapy may be either DNA or RNA sequences. Preferred methods using antisense polynucleotide according to the present invention are the procedures described by Sczakiel et al. (1995), which disclosure is hereby incorporated by reference in its entirety.

Preferably, the antisense tools are chosen among the polynucleotides (15–200 bp long) that are complementary to GENSET mRNA, more preferably to the 5' end of the GENSET mRNA. In another embodiment, a combination of different antisense polynucleotides complementary to different parts of the desired targeted gene are used.

Other preferred antisense polynucleotides according to the present invention are sequences complementary to either a sequence of GENSET mRNAs comprising the translation initiation codon ATG or a sequence of GENSET genomic DNA containing a splicing donor or acceptor site.

Preferably, the antisense polynucleotides of the invention have a 3' polyadenylation signal that has been replaced with a self-cleaving ribozyme sequence, such that RNA polymerase II transcripts are produced without poly(A) at their 3' ends, these antisense polynucleotides being incapable of export from the nucleus, such as described by Liu et al. (1994), which disclosure is hereby incorporated by reference in its entirety. In a preferred embodiment, these GENSET antisense polynucleotides also comprise, within the ribozyme cassette, a histone stem-loop structure to stabilize cleaved transcripts against 3'-5' exonucleolytic degradation, such as the structure described by Eckner et al. (1991), which disclosure is hereby incorporated by reference in its entirety.

The antisense nucleic acids should have a length and melting temperature sufficient to permit formation of an intracellular duplex having sufficient stability to inhibit the expression of the GENSET mRNA in the duplex. Strategies for designing antisense nucleic acids suitable for use in gene therapy are disclosed in Green et al., (1986) and Izant and Weintraub, (1984), the disclosures of which are incorporated herein by reference.

In some strategies, antisense molecules are obtained by reversing the orientation of the GENSET coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of GENSET antisense nucleic acids in vivo by operably linking DNA containing the antisense sequence to a promoter in a suitable expression vector.

Alternatively, oligonucleotides which are complementary to the strand normally transcribed in the cell may be synthesized in vitro. Thus, the antisense nucleic acids are complementary to the corresponding mRNA and are capable of hybridizing to the mRNA to create a duplex. In some embodiments, the antisense sequences may contain modified sugar phosphate backbones to increase stability and make them less sensitive to RNase activity. Examples of modifications suitable for use in antisense strategies include 2' O-methyl RNA oligonucleotides and Protein-nucleic acid (PNA) oligonucleotides. Further examples are described by Rossi et al., (1991), which disclosure is hereby incorporated by reference in its entirety.

Various types of antisense oligonucleotides complementary to the sequence of the GENSET cDNA or genomic DNA may be used. In one preferred embodiment, stable and semi-stable antisense oligonucleotides described in International Application No. PCT WO94/23026, hereby incorporated by reference, are used. In these molecules, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides against herpes simplex virus types 1 and 2 described in International Application No. WO95/04141, hereby incorporated by reference, are used.

In yet another preferred embodiment, the covalently cross-linked antisense oligonucleotides described in International Application No. WO 96/31523, hereby incorporated by reference, are used. These double- or single-stranded oligonucleotides comprise one or more, respectively, inter- or intra-oligonucleotide covalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, incorporated by reference, may also be used. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, hereby incorporated by reference are used. These ligated oligonucleotide "dumb-bells" contain the binding site for a transcription factor and inhibit expression of the gene under control of the transcription factor by sequestering the factor.

Use of the closed antisense oligonucleotides disclosed in International Application No. WO 92/19732, hereby incorporated by reference, is also contemplated. Because these molecules have no free ends, they are more resistant to degradation by exonucleases than are conventional oligonucleotides. These oligonucleotides may be multifunctional, interacting with several regions which are not adjacent to the target mRNA.

The appropriate level of antisense nucleic acids required to inhibit gene expression may be determined using in vitro expression analysis. The antisense molecule may be introduced into the cells by diffusion, injection, infection or transfection using procedures known in the art. For example, the antisense nucleic acids can be introduced into the body as a bare or naked oligonucleotide, oligonucleotide encapsulated in lipid, oligonucleotide sequence encapsidated by viral protein, or as an oligonucleotide operably linked to a promoter contained in an expression vector. The expression vector may be any of a variety of expression vectors known in the art, including retroviral or viral vectors, vectors capable of extrachromosomal replication, or integrating vectors. The vectors may be DNA or RNA.

The antisense molecules are introduced onto cell samples at a number of different concentrations preferably between $1\times10^{-10}$M to $1\times10^{-4}$M. Once the minimum concentration that can adequately control gene expression is identified, the optimized dose is translated into a dosage suitable for use in vivo. For example, an inhibiting concentration in culture of $1\times10^{-7}$ translates into a dose of approximately 0.6 mg/kg bodyweight. Levels of oligonucleotide approaching 100 mg/kg bodyweight or higher may be possible after testing the toxicity of the oligonucleotide in laboratory animals. It is additionally contemplated that cells from the vertebrate are removed, treated with the antisense oligonucleotide, and reintroduced into the vertebrate.

In a preferred application of this invention, the polypeptide encoded by the gene is first identified, so that the effectiveness of antisense inhibition on translation can be monitored using techniques that include but are not limited to antibody-mediated tests such as RIAs and ELISA, functional assays, or radiolabeling.

An alternative to the antisense technology that is used according to the present invention comprises using ribozymes that will bind to a target sequence via their complementary polynucleotide tail and that will cleave the corresponding RNA by hydrolyzing its target site (namely "hammerhead ribozymes"). Briefly, the simplified cycle of a hammerhead ribozyme comprises (1) sequence specific binding to the target RNA via complementary antisense sequences; (2) site-specific hydrolysis of the cleavable motif of the target strand; and (3) release of cleavage products, which gives rise to another catalytic cycle. Indeed, the use of long-chain antisense polynucleotide (at least 30 bases long) or ribozymes with long antisense arms are advantageous. A preferred delivery system for antisense ribozyme is achieved by covalently linking these antisense ribozymes to lipophilic groups or to use liposomes as a convenient vector. Preferred antisense ribozymes according to the present invention are prepared as described by Rossi et al, (1991) and Sczakiel et al. (1995), the specific preparation procedures being referred to in said articles being herein incorporated by reference.

Triple Helix Approach

The GENSET genomic DNA may also be used to inhibit the expression of the GENSET gene based on intracellular triple helix formation.

Triple helix oligonucleotides are used to inhibit transcription from a genome. They are particularly useful for studying alterations in cell activity when it is associated with a particular gene. The GENSET cDNAs or genomic DNAs of the present invention or, more preferably, a fragment of those sequences, can be used to inhibit gene expression in individuals having diseases associated with expression of a particular gene. Similarly, a portion of the GENSET genomic DNA can be used to study the effect of inhibiting GENSET transcription within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from the GENSET genomic DNA are contemplated within the scope of this invention.

To carry out gene therapy strategies using the triple helix approach, the sequences of the GENSET genomic DNA are first scanned to identify 10-mer to 20-mer homopyrimidine or homopurine stretches which could be used in triple-helix based strategies for inhibiting GENSET expression. Following identification of candidate homopyrimidine or homopurine stretches, their efficiency in inhibiting GENSET expression is assessed by introducing varying amounts of oligonucleotides containing the candidate sequences into tissue culture cells which express the GENSET gene.

The oligonucleotides can be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced GENSET expression using techniques such as Northern blotting, RNase protection assays, or PCR based strategies to monitor the transcription levels of the GENSET gene in cells which have been treated with the oligonucleotide. The cell functions to be monitored are predicted based upon the homologies of the target gene corresponding to the cDNA from which the oligonucleotide was derived with known gene sequences that have been associated with a particular function. The cell functions can also be predicted based on the presence of abnormal physiology within cells derived from individuals with a particular inherited disease, particularly when the cDNA is associated with the disease using techniques described in the section entitled "Identification of genes associated with hereditary diseases or drug response".

The oligonucleotides which are effective in inhibiting gene expression in tissue culture cells may then be introduced in vivo using the techniques and at a dosage calculated based on the in vitro results, as described in the section entitled "Antisense Approach".

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (1989), which is hereby incorporated by this reference.

Treating GENSET-Related Disorders

The present invention further relates to methods of treating diseases/disorders by increasing GENSET activity and/ or expression. The invention also relates to methods of treating diseases/disorders by decreasing GENSET activity and or expression. These methodologies can be effected using compounds selected using screening protocols such as those described herein and/or by using the gene therapy and antisense approaches described in the art and herein. Gene therapy can be used to effect targeted expression of GENSET. The GENSET coding sequence can be cloned into an appropriate expression vector and targeted to a particular cell type(s) to achieve efficient, high level expression. Introduction of the GENSET coding sequence into target cells can be achieved, for example, using particle mediated DNA delivery, (Haynes, 1996 and Maurer, 1999), direct injection of naked DNA, (Levy et al., 1996; and Felgner, 1996), or viral vector mediated transport (Smith et al., 1996, Stone et al, 2000; Wu and Atai, 2000), each of which disclosures are hereby incorporated by reference in their entireties. Tissue specific effects can be achieved, for example, in the case of virus mediated transport by using viral vectors that are tissue specific, or by the use of promoters that are tissue specific.

Combinatorial approaches can also be used to ensure that the GENSET coding sequence is activated in the target tissue (Butt and Karathanasis, 1995; Miller and Whelan, 1997), which disclosures are hereby incorporated by reference in their entireties. Antisense oligonucleotides complementary to GENSET mRNA can be used to selectively diminish or ablate the expression of the protein, for example, at sites of inflammation. More specifically, antisense constructs or antisense oligonucleotides can be used to inhibit the production of GENSET in high expressing cells such as those cited in the third column of Table X. Antisense mRNA can be produced by transfecting into target cells an expression vector with the GENSET gene sequence, or portion thereof, oriented in an antisense direction relative to the direction of transcription. Appropriate vectors include viral vectors, including retroviral, adenoviral, and adeno-associated viral vectors, as well as nonviral vectors. Tissue specific promoters can be used. Alternatively, antisense oligonucleotides can be introduced directly into target cells to achieve the same goal. (See also other delivery methodologies described herein in connection with gene therapy.). Oligonucleotides can be selected/designed to achieve a high level of specificity (Wagner et al., 1996), which disclosure is hereby incorporated by reference in its entirety. The therapeutic methodologies described herein are applicable to both human and non-human mammals (including cats and dogs).

Pharmaceutical and Physiologically Acceptable Compositions

The present invention also relates to pharmaceutical or physiologically acceptable compositions comprising, as active agent, the polypeptides, nucleic acids or antibodies of the invention. The invention also relates to compositions comprising, as active agent, compounds selected using the above-described screening protocols. Such compositions include the active agent in combination with a pharmaceutical or physiologically acceptably acceptable carrier. In the case of naked DNA, the "carrier" may be gold particles. The amount of active agent in the composition can vary with the agent, the patient and the effect sought. Likewise, the dosing regimen can vary depending on the composition and the disease/disorder to be treated.

Therefore, the invention related to methods for the production of pharmaceutical composition comprising a method for selecting an active agent, compound, substance or molecule using any of the screening method described herein and furthermore mixing the identified active agent, compound, substance or molecule with a pharmaceutically acceptable carrier.

The pharmaceutical compositions utilized in this invention may be administered by any number of routes including, but not limited to, oral, intravenous, intramuscular, intra-arterial, intramedullary, intrathecal, intraventricular, transdermal, subcutaneous, intraperitoneal, intranasal, enteral, topical, sublingual, or rectal means. In addition to the active ingredients, these pharmaceutical compositions may contain suitable pharmaceutically acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Maack PublishingCo. Easton, Pa.).

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the patient.

Pharmaceutical preparations for oral use can be obtained through a combination of active compounds with solid excipient, suiting mixture is optionally grinding, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethylcellulose, or sodium carboxymethylcellulose; gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores may be used in conjunction with suitable coatings, such as concentrated sugar solutions, which may also contain gum arabic, talc, polyvinylpyrrolidone, carbopol gel, polyethylene glycol, and/or titaniumdioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations which can be used orally include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquidpolyethylene glycol with or without stabilizers.

Pharmaceutical formulations suitable for parenteral administration may be formulated in aqueous solutions, preferably in physiologically compatible buffers such as Hanks solution, Ringer's solution, or physiologically buffered saline. Aqueous injection suspensions may contain substances which increase the viscosity of the suspension, such as sodium carboxymethylcellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For topical or nasal administration, penetrants appropriate to the particular barrier to be permeated are used in the formulation. Such penetrants are generally known in the art.

The pharmaceutical compositions of the present invention may be manufactured in a manner that is known in the art, e.g., by means of conventional mixing, dissolving, granulating, dragee-making, levigating, emulsifying, encapsulating, entrapping, or lyophilizing processes.

The pharmaceutical composition may be provided as a salt and can be formed with many acids, including but not limited to, hydrochloric, sulfuric, acetic, lactic, tartaric, malic, succinic, etc. Salts tend to be more soluble in aqueous or other protonic solvents than are the corresponding free base forms. In other cases, the preferred preparation may be a lyophilized powder which may contain any or all of the following: 1–50 mM histidine, 0.1%–2% sucrose, and 2–7% mannitol, at a pH range of 4.5 to 5.5, that is combined with buffer prior to use.

After pharmaceutical compositions have been prepared, they can be placed in an appropriate container and labeled for treatment of an indicated condition. For administration of GENSET, such labeling would include amount, frequency, and method of administration.

Pharmaceutical compositions suitable for use in the invention include compositions wherein the active ingredients are contained in an effective amount to achieve the intended purpose. The determination of an effective dose is well within the capability of those skilled in the art.

For any compound, the therapeutically effective dose can be estimated initially either in cell culture assays, e.g., of neoplastic cells, or in animal models, usually mice, rabbits, dogs, or pigs. The animal model may also be used to determine the appropriate concentration range and route of administration. Such information can then be used to determine useful doses and routes for administration in humans.

A therapeutically effective dose refers to that amount of active ingredient, for example GENSET or fragments thereof, antibodies of GENSET, agonists, antagonists or inhibitors of GENSET, which ameliorates the symptoms or condition. Therapeutic efficacy and toxicity may be determined by standard pharmaceutical procedures in cell cultures or experimental animals, e.g., ED50 (the dose therapeutically effective in 50% of the population) and LD50 (the dose lethal to 50% of the population). The dose ratio between therapeutic and toxic effects is the therapeutic index, and it can be expressed as the ratio, LD50/ED50. Pharmaceutical compositions which exhibit large therapeutic indices are preferred. The data obtained from cell culture assays and animal studies is used in formulating a range of dosage for human use. The dosage contained in such compositions is preferably within a range of circulating concentrations that include the ED50 with little or no toxicity. The dosage varies within this range depending upon the dosage form employed, sensitivity of the patient, and the route of administration.

The exact dosage will be determined by the practitioner, in light of factors related to the subject that requires treatment. Dosage and administration are adjusted to provide sufficient levels of the active moiety or to maintain the desired effect. Factors which may be taken into account include the severity of the disease state, general health of the subject, age, weight, and gender of the subject, diet, time and frequency of administration, drug combination(s), reaction sensitivities, and tolerance/response to therapy. Long-acting pharmaceutical compositions maybe administered every 3 to 4 days, every week, or once every two weeks depending on half-life and clearance rate of the particular formulation.

Normal dosage amounts may vary from 0.1 to 100,000 micrograms, up to a total dose of about 1 g, depending upon the route of administration. Guidance as to particular dosages and methods of delivery is provided in the literature and generally available to practitioners in the art. Those skilled in the art will employ different formulations for nucleotides than for proteins or their inhibitors. Similarly, delivery of polynucleotides or polypeptides will be specific to particular cells, conditions, locations, etc.

Uses of GENSET Sequences: Computer-Related Embodiments

As used herein the term "cDNA codes of SEQ ID Nos: 1–241" encompasses the nucleotide sequences of SEQ ID Nos: 1–241 and of clones inserts of the deposited clone pool, fragments thereof, nucleotide sequences homologous thereto, and sequences complementary to all of the preceding sequences. The fragments include fragments of SEQ ID Nos: 1–241 comprising at least 8, 10, 12, 15, 18, 20, 25, 28, 30, 35, 40, 50, 75, 100, 150, 200, 300, 400, 500, 1000 or 2000 consecutive nucleotides of SEQ ID Nos: 1–241. Preferably the fragments include signal sequences and coding sequences for mature polypeptides of SEQ ID Nos: 1–31 and 33–143, polynucleotides described in Tables Va and Table Vb, polynucleotides encoding polypeptides described in Table VI, polynucleotide described herein as encoding polypeptides having a biological activity, or fragments comprising at least 8, 10, 12, 15, 18, 20, 25, 28, 30, 35, 40, 50, 75, 100, 150, 200, 300, 400, 500, 1000 or 2000 consecutive nucleotides of the signal sequences or coding sequences for mature polypeptides of SEQ ID Nos: 1–31 and 33–143, polynucleotides described in Tables Va and Table Vb, polynucleotides encoding polypeptides described in Table VI, and polynucleotide described herein as encoding polypeptides having a biological activity. Homologous sequences and fragments of SEQ ID Nos: 1–241 refer to a sequence having at least 99%, 98%, 97%, 96%, 95%, 90%, 85%, 80%, or 75% identity to these sequences. Identity may be determined using any of the computer programs and parameters described herein, including BLAST2N with the default parameters or with any modified parameters. Homologous sequences also include RNA sequences in which uridines replace the thymines in the cDNA codes of SEQ ID Nos: 1–241. The homologous sequences may be obtained using any of the procedures described herein or may result from the correction of a sequencing error as described above. Preferably the homologous sequences and fragments of SEQ ID Nos: 1–241 include polynucleotides homologous to signal sequences and coding sequences for mature polypeptides of SEQ ID Nos: 1–31 and 33–143, polynucleotides described in Tables Va and Table Vb, polynucleotides encoding a polypeptide fragment described as a domain in Table VI, polynucleotide described herein as encoding polypeptides having a biological activity, or fragments comprising at least 8, 10, 12, 15, 18, 20, 25, 28, 30, 35, 40, 50, 75, 100, 150, 200, 300, 400, 500, 1000 or 2000 consecutive nucleotides of the signal sequences and coding sequences for mature polypeptides of SEQ ID Nos: 1–31 and 33-143, polynucleotides described in Tables Va and Table Vb, polynucleotides described in Table VI, and polynucleotide described herein as encoding polypeptides having a biological activity. It will be appreciated that the cDNA codes of SEQ ID Nos: 1–241 can be represented in the traditional single character format (See the inside back cover of Styer, 1995) or in any other format which records the identity of the nucleotides in a sequence.

As used herein the term "polypeptide codes of SEQ ID Nos: 242–482" encompasses the polypeptide sequences of SEQ ID Nos: 242–482, the signal peptides included in SEQ ID Nos: 242–272 and 274–384, the mature polypeptides included in SEQ ID Nos: 242–272 and 274–384, the full-length, signal peptides and mature polypeptide sequences encoded by the clone inserts of the deposited clone pool, polypeptide sequences homologous thereto, or fragments of any of the preceding sequences. Homologous polypeptide sequences refer to a polypeptide sequence having at least 99%, 98%, 97%, 96%, 95%, 90%, 85%, 80%, 75% identity to one of the polypeptide sequences of SEQ ID Nos: 242–482, the signal peptides included in SEQ ID Nos: 242–272 and 274–384, the mature polypeptides included in SEQ ID Nos: 242–272 and 274–384, the full-length, signal peptides and mature polypeptide sequences encoded by the clone inserts of the deposited clone pool. Identity may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 5, 6, 8, 10, 12, 15, 20, 25, 30, 35, 40, 50, 60, 75, 100, 150, 200, 250, 300, 350, 400, 450 or 500 consecutive amino acids of the polypeptides of SEQ ID Nos: 242–482. Preferably, the fragments include polypeptides encoded by the signal peptides included in SEQ ID Nos: 242–272 and 274–384, mature polypeptides included in SEQ ID Nos: 242–272 and 274–384, polynucleotides described in Tables Va and in Table Vb, domains described in Table VI, epitopes described in Table VII, polypeptides described herein as having a biological activity, or fragments comprising at least 5, 10, 15, 20, 25, 30, 35, 40, 50, 75, 100, 150, 200, 300 or 400 consecutive amino acids of the signal peptides included in SEQ ID Nos: 242–272 and 274–384, mature polypeptides included in SEQ ID Nos: 242–272 and 274–384, the polypeptides encoded by the polynucleotides described in Tables Va and in Table Vb, domains of Table VI, epitopes of Table VII or of polypeptides described herein as having a biological activity. It will be appreciated that the polypeptide codes of the SEQ ID Nos: 242–482 can be represented in the traditional single character format or three letter format (See the inside back cover of Stryer, 1995) or in any other format which relates the identity of the polypeptides in a sequence.

It will be appreciated by those skilled in the art that the nucleic acid codes of the invention and polypeptide codes of the invention can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of the invention, or one or more of the polypeptide codes of the invention. Another aspect of the present invention is a computer readable medium having recorded thereon at least 2, 5, 10, 15, 20, 25, 30, 50, 75, 100, 150 or 200 nucleic acid codes of the invention. Another aspect of the present invention is a computer readable medium having recorded thereon at least 2, 5, 10, 15, 20, 25, 30, 50, 75, 100, 150 or 200 polypeptide codes of the invention.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other apes of other media known to those skilled in the art.

Figure 2:
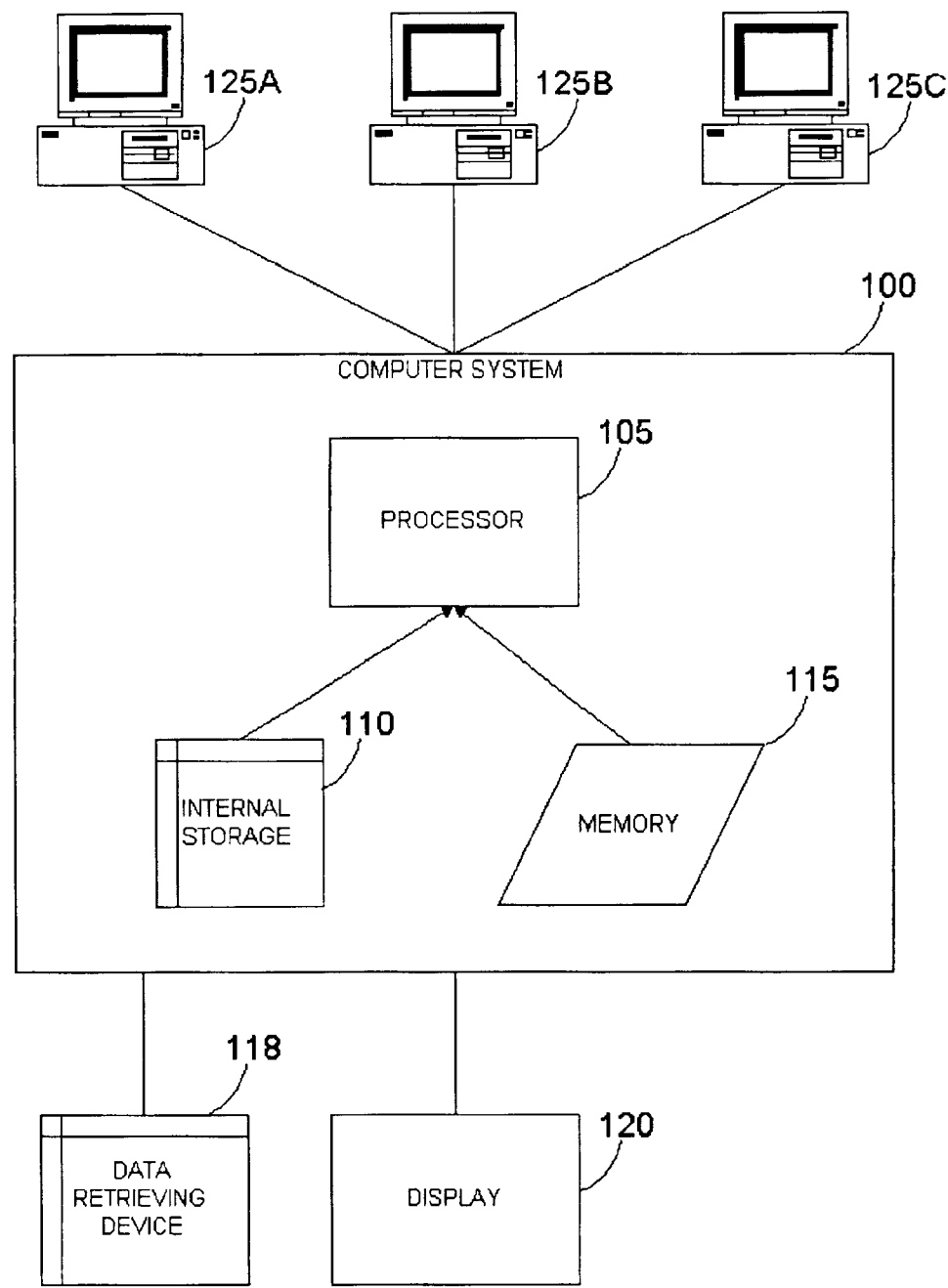
FIG. 2 is a block diagram of an exemplary computer system.

Embodiments of the present invention include systems, particularly computer systems which store and manipule the sequence information described herein. One example of a computer system 100 is illustrated in block diagram form in FIG. 2. As used herein, "a computer system" refers to the hardware components, software components, and data storage components used to analyze the nucleotide sequences of the nucleic acid codes of the invention or the amino acid sequences of the polypeptide codes of the invention. In one embodiment, the computer system 100 is a Sun Enterprise 1000 server (Sun Microsystems, Palo Alto, Calif.). The computer system 100 preferably includes a processor for processing, accessing and manipulating the sequence data The processor 105 can be any well-known type of central unit, such as the Pentium III from Intel Corporation, or similar processor from Sun, Motorola, Compaq or International Business Machines.

Preferably, the computer system 100 is a general purpose system that comprises the processor 105 and one or more interal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a–c in a network or wide area network to provide centralized access to the computer system 100.

Software for accessing and processing the nucleotide sequences of the nucleic acid codes of the invention or the amino acid sequences of the polypeptide codes of tie invention (such as search tools, compare tools, and modeling tools etc.) may reside in main memory 115 during execution.

In some embodiments, the computer system 100 may further comprise a sequence comparer for comparing the above-described nucleic acid codes of the invention or the polypeptide codes of the invention stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of nucleic acid codes of the invention or the amino acid sequences of the polypeptide codes of the invention stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

Figure 3:
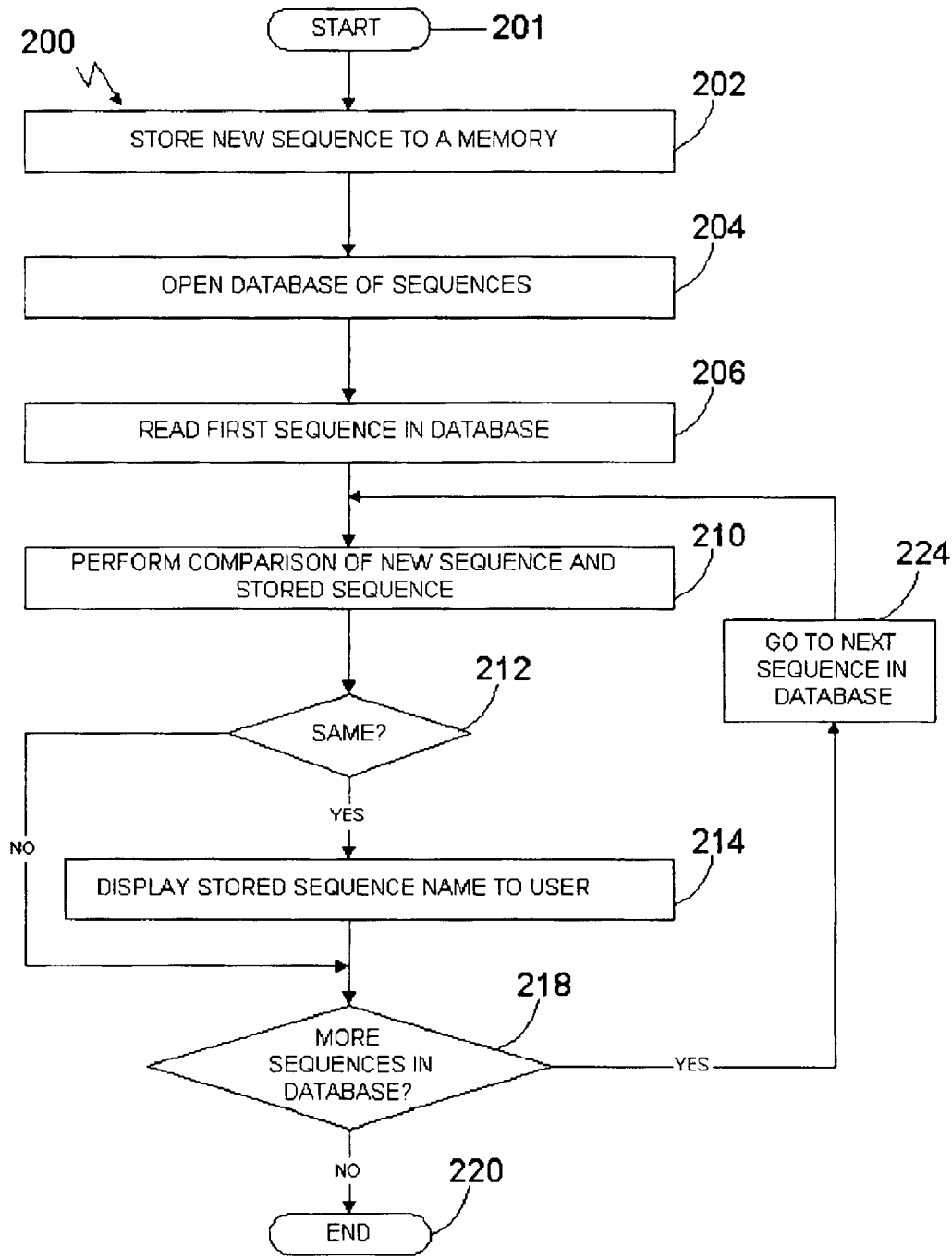
FIG. 3 is a flow diagram illustrating one embodiment of a process 200 for comparing a new nucleotide or protein sequence with a database of sequences in order to determine the identity levels between the new sequence and the sequences in the database.

FIG. 3 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR OR SWIS-SPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of the invention or a polypeptide code of the invention,. In some embodiments the computer system further comprises a data storage device having retrievably stored thereon reference nucleotide sequences or polypeptide sequences to be compared to the nucleic acid code of the invention or polypeptide code of the invention and a sequence comparer for conducting the comparison. For example, the sequence comparer may comprise a computer program which indicates polymorphisms. In other aspects of the computer system, the system further comprises an identifier which identifies features in said sequence. The sequence comparer may indicate a homology level between the sequences compared or identify motifs implicated in biological function and structural motifs in the nucleic acid code of the invention and polypeptide codes of the invention or it may identify structural motifs in sequences which are compared to these nucleic acid codes and polypeptide codes. In some embodiments, the data storage device may have stored thereon the sequences of at least 2, 5, 10, 15, 20, 25, 30, 50, 75, 100, 150 or 200 of the nucleic acid codes of the invention or polypeptide codes of the invention.

Another aspect of the present invention is a method for determining the level of homology between a nucleic acid code of the invention and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, 50, 75, 100, 150 or 200 of the above described nucleic acid codes of the invention through the use of the computer program and determining homology between the nucleic acid codes and reference nucleotide sequences.

Figure 4:
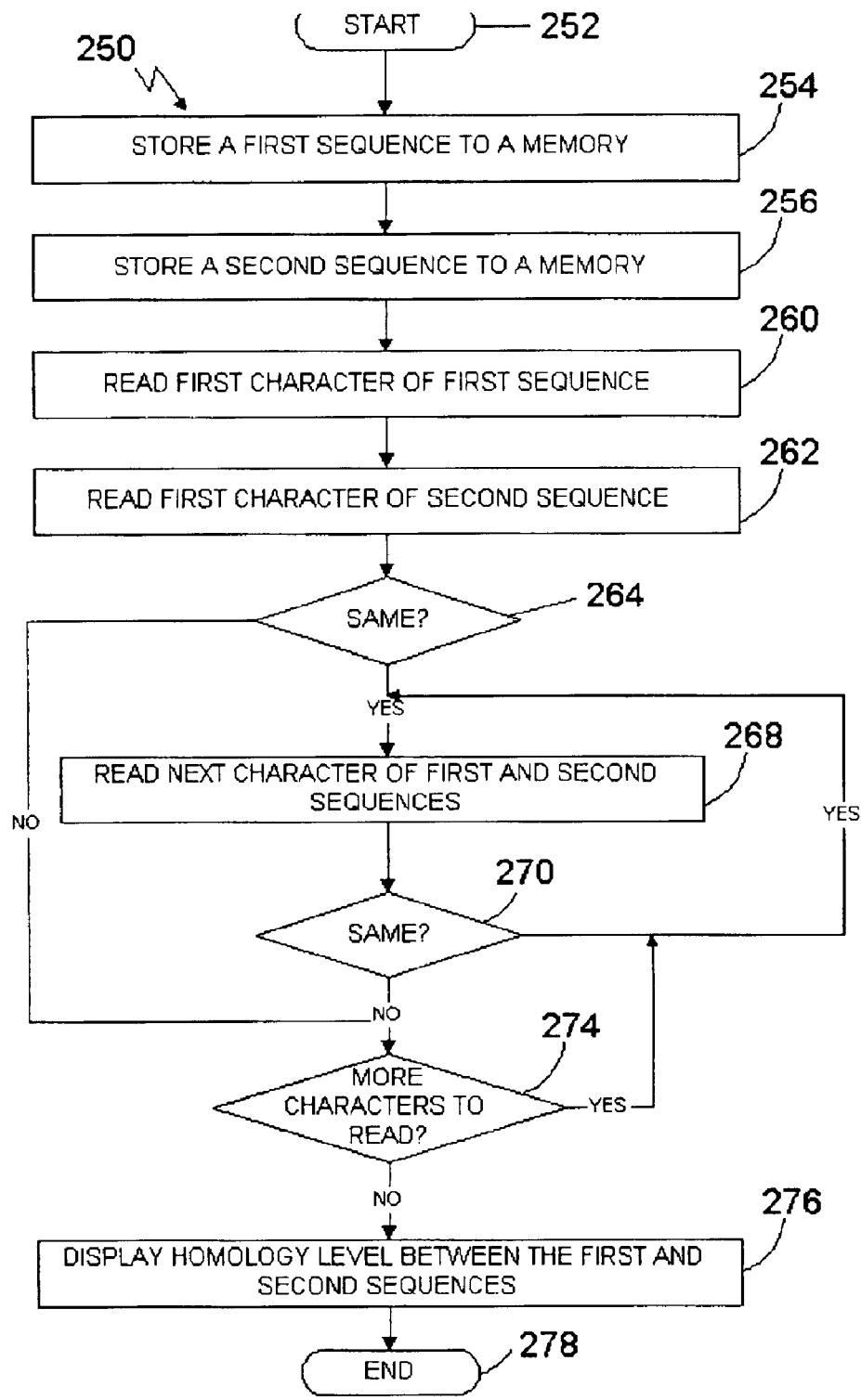
FIG. 4 is a flow diagram illustrating one embodiment of a process 250 in a computer for determining whether two sequences are homologous.

FIG. 4 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of the invention differs from a reference nucleic acid sequence at one or more positions. Optionally such a program records the length and identity of inserted, deleted or substituted nucleotides with respect to the sequence of either the reference polynucleotide or the nucleic acid code of the invention. In one embodiment, the computer program may be a program which determines whether the nucleotide sequences of the nucleic acid codes of the invention contain one or more single nucleotide polymorphisms (SNP) with respect to a reference nucleotide sequence. These single nucleotide polymorphisms may each comprise a single base substitution, insertion, or deletion.

Another embodiment of the present invention is a method for comparing a first sequence to a reference sequence wherein the first sequence is selected from the group consisting of a cDNA code of SEQID NOs. 1–297 and a polypeptide code of SEQ ID NOs. 298–594 comprising the steps of reading the first sequence and the reference sequence through use of a computer program which compares sequences and determining differences between the first sequence and the reference sequence with the computer program. In some aspects of this embodiment, said step of determining differences between the first sequence and the reference sequence comprises identifying polymorphisms.

Another aspect of the present invention is a method for determining the level of homology between a polypeptide code of the invention and a reference polypeptide sequence, comprising the steps of reading the polypeptide code of the invention and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of the invention differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms The method may be implemented by the computer systems described above and the method illustrated in FIG. 4. The method may also be performed by reading at least 2, 5, 10, 15, 20, 25, 30, 50, 75, 100, 150 or 200 of the nucleic acid codes of the invention and the reference nucleotide sequences through the use of the computer program and identifying differences between the nucleic acid codes and the reference nucleotide sequences with the computer program.

Thus, another embodiment of the present invention is a method for comparing a first sequence to a reference sequence wherein the first sequence is selected from the group consisting of the nucleic acid codes of the present invention or the polypeptide codes of the present invention comprising the steps of reading the first sequence and the reference sequence through use of a computer program which compares sequences and determining differences between the first sequence and the reference sequence with the computer program. In some aspects of this embodiment, said step of determining differences between the first sequence and the reference sequence comprises identifying polymorphisms.

Another aspect of the present invention is a method for determining the level of identity between a first sequence and a reference sequence, wherein the first sequence is selected from the group consisting of the nucleic acid codes of the present invention or the polypeptide codes of the present invention, comprising the steps of reading the first sequence and the reference sequence through the use of a computer program which determines identity levels and determining identity between the first sequence and the reference sequence with the computer program.

In other embodiments the computer based system may further comprise an identifier for identifying features within the nucleotide sequences of the nucleic acid codes of the invention or the amino acid sequences of the polypeptide codes of the invention. An "identifier" refers to one or more programs which identifies certain features within the above-described nucleotide sequences of the nucleic acid codes of the invention or the amino acid sequences of the polypeptide codes of the invention. In one embodiment, the identifier may comprise a program which identifies an open reading frame in the cDNAs codes of the invention.

Another embodiment of the present invention is a method for identifying a feature in a sequence selected from the group consisting of the nucleic acid codes of the invention or the amino acid sequences of the polypeptide codes of the invention comprising the steps of reading the sequence through the use of a computer program which identifies features in sequences and identifying features in the sequence with said computer program. In one aspect of this embodiment, the computer program comprises a computer program which identifies open reading frames. In a further embodiment, the computer program comprises a program that identifies linear or structural motifs in a polypeptide sequence.

Figure 5:
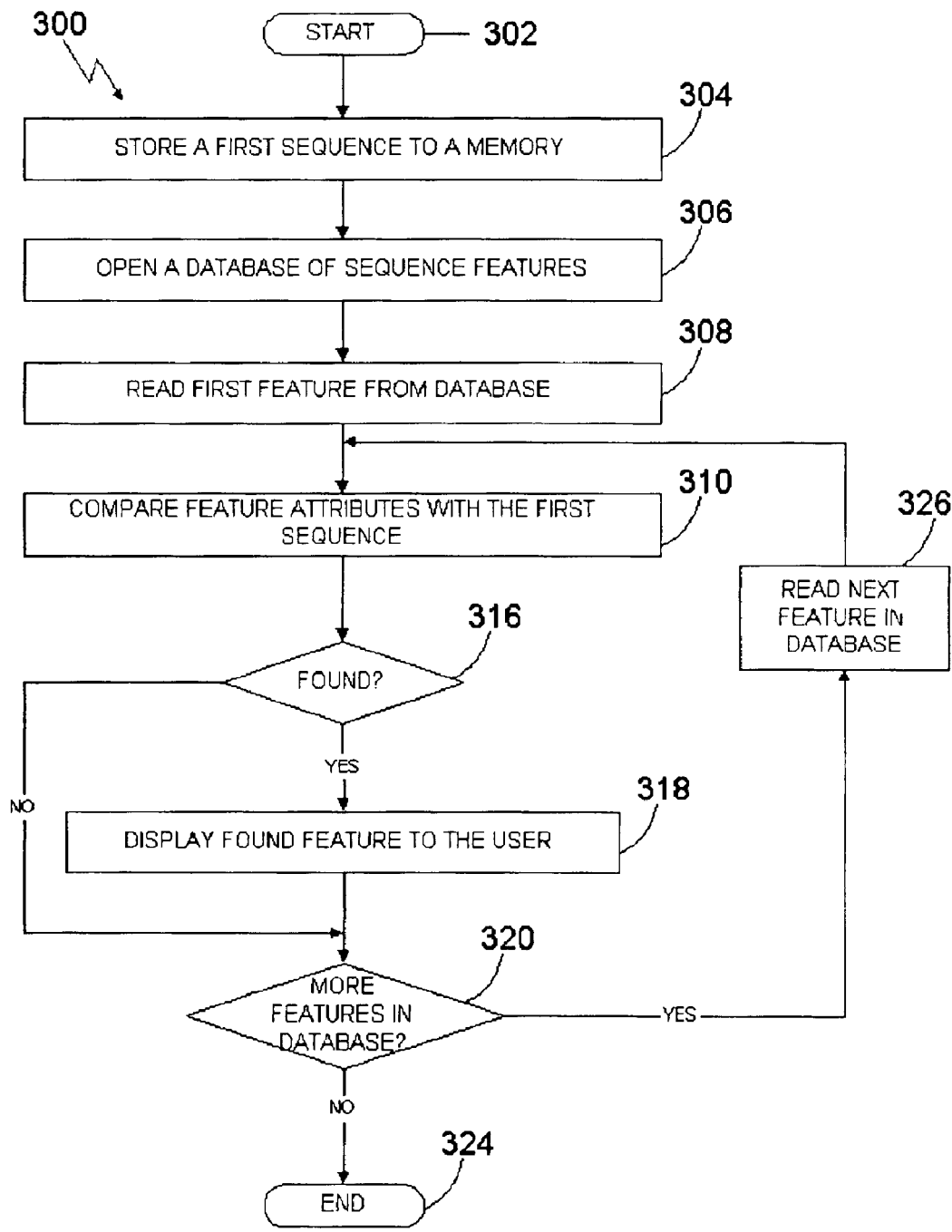
FIG. 5 is a flow diagram illustrating one embodiment of an identifier process 300 for detecting the presence of a feature in a sequence.

FIG. 5 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of the invention. Such programs may use any methods known to those skilled in the art including methods based on homology-modeling, fold recognition and ab initio methods as described in Sternberg et al., 1999, which disclosure is hereby incorporated by reference in its entirety. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995, which disclosure is hereby incorporated by reference in its entirety). In another technique, the known three-dimensional structures of proteins in a given family are superimposed to define the structurally conserved regions in that family. This protein modeling technique also uses the known three-dimensional structure of a homologous protein to approximate the structure of the polypeptide codes of the invention. (See e.g., Srinivasan, et al., U.S. Pat. No. 5,557,535 issued Sep. 17, 1996, which disclosure is hereby incorporated by reference in its entirety). Conventional homology modeling techniques have been used routinely to build models of proteases and antibodies. (Sowdhamini et al., (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszodi et al., (1997)).

The results of the molecular modeling analysis may then be used in rational drug design techniques to identify agents which modulate the activity of the polypeptide codes of the invention.

Accordingly, another aspect of the present invention is a method of identifying a feature within the nucleic acid codes of the invention or the polypeptide codes of the invention comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies linear or structural motifs in a polypeptide sequence. In another embodiment, the computer program comprises a molecular modeling program. The method may be performed by reading a single sequence or at least 2, 5, 10, 15, 20, 25, 30, 50, 75, 100, 150 or 200 of the nucleic acid codes of the invention or the polypeptide codes of the invention through the use of the computer program and identifying features within the nucleic acid codes or polypeptide codes with the computer program.

The nucleic acid codes of the invention or the polypeptide codes of the invention may be stored and manipulated in a variety of data processor programs in a variety of formats. For example, they may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of the invention or the polypeptide codes of the invention. The following list is intended not to limit the invention but to provide guidance to programs and databases which are useful with the nucleic acid codes of the invention or the polypeptide codes of the invention. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, 1990), FASTA (Pearson and Lipman, 1988), FASTDB (Brutlag et al., 1990), Catalyst (Molecular Simulations Inc.), Catalyst/SHAPE (Molecular Simulations Inc.), Cerius2.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report database, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Conclusion

As discussed above, the GENSET polynucleotides and polypeptides of the present invention or fragments thereof can be used for various purposes. The polynucleotides can be used to express recombinant protein for analysis, characterization or therapeutic use; as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; as a reagent (including a labeled reagent) in assays designed to quantitatively determine levels of GENSET expression in biological samples; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotide encodes a protein which binds or potentially binds to another protein (such as, for example, in a receptor-ligand interaction), the polynucleotide can also be used in interaction trap assays (such as, for example, that described in Gyuris et al., (1993) to identify polynucleotides encoding the other protein with which binding occurs or to identify inhibitors of the binding interaction.

The proteins or polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein binds or potentially binds to another protein (such as, for example, in a receptor-ligand interaction), the protein can be used to identify the other protein with which binding occurs or to identify inhibitors of the binding interaction. Proteins involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning; A Laboratory Manual", 2d ed., Cole Spring Harbor Laboratory Press, Sambrook, J., E. F. Fritsch and T. Maniatis eds., 1989, and "Methods in Enzymology; Guide to Molecular Cloning Techniques", Academic Press, Berger and Kimmel eds., 1987, which disclosures are hereby incorporated by reference in their entireties.

Polynucleotides and proteins of the present invention can also be used as nutritional sources or supplements. Such uses include without limitation use as a protein or amino acid supplement, use as a carbon source, use as a nitrogen source and use as a source of carbohydrate. In such cases the protein or polynucleotide of the invention can be added to the feed of a particular organism or can be administered as a separate solid or liquid preparation, such as in the form of powder, pills, solutions, suspensions or capsules. In the case of microorganisms, the protein or polynucleotide of the invention can be added to the medium in or on which the microorganism is cultured.

Although this invention has been described in terms of certain preferred embodiments, other embodiments which will be apparent to those of ordinary skill in the art in view of the disclosure herein are also within the scope of this invention. Accordingly, the scope of the invention is intended to be defined only by reference to the appended claims.

EXAMPLES

Preparation of Antibody Compositions to GENSET Proteins

Substantially pure protein or polypeptide is isolated from transfected or transformed cells containing an expression vector encoding a GENSET protein or a portion thereof. The concentration of protein in the final preparation is adjusted, for example, by concentration on an Amicon filter device, to the level of a few micrograms/ml. Monoclonal or polyclonal antibody to the protein can then be prepared as follows:

A. Monoclonal Antibody Production by Hybridoma Fusion

Monoclonal antibody to epitopes in the GENSET protein or a portion thereof can be prepared from murine hybridomas according to the classical method of Kohler and Milstein, (1975) or derivative methods thereof. Also see Harlow and Lane. (1988).

Briefly, a mouse is repetitively inoculated with a few micrograms of the GENSET protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, (1980), which disclosure is hereby incorporated by reference in its entirety, and derivative methods thereof. Selected positive clones can be expanded and their monoclonal antibody product harvested for use. Detailed procedures for monoclonal antibody production are described in Davis, et al. (1986) Section 21-2.

B. Polyclonal Antibody Production by Immunization

Polyclonal antiserum containing antibodies to heterogeneous epitopes in the GENSET protein or a portion thereof can be prepared by immunizing suitable non-human animal with the GENSET protein or a portion thereof, which can be unmodified or modified to enhance immunogenicity. A suitable non-human animal is preferably a non-human mammal is selected, usually a mouse, rat, rabbit, goat, or horse.

Alternatively, a crude preparation which has been enriched for GENSET concentration can be used to generate antibodies. Such proteins, fragments or preparations are introduced into the non-human mammal in the presence of an appropriate adjuvant (e.g. aluminum hydroxide, RIBI, etc.) which is known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art. An effective immunization protocol for rabbits can be found in Vaitukaitis et al. (1971), which disclosure is hereby incorporated by reference in its entirety.

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony et al., (1973), which disclosure is hereby incorporated by reference in its entirety. Plateau concentration of antibody is usually in the range of 0.1 to 0.2 mg/ml of serum (about 12 uM). Affinity of the antisera for the antigen is determined by preparing competitive binding curves, as described, for example, by Fisher (1980), which disclosure is hereby incorporated by reference in its entirety.

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

Biological Assays

Assaying GENSET Secreted Proteins to Determine Whether they Bind to the Cell Surface The secreted proteins encoded by the GENSET cDNAs, preferably the proteins of SEQ ID NOs: 242–272 and 274–384, or fragments thereof are cloned into expression vectors. The proteins are purified by size, charge, immunochromatography or other techniques familiar to those skilled in the art. Following purification, the proteins are labeled using techniques known to those skilled in the art. The labeled proteins are incubated with cells or cell lines derived from a variety of organs or tissues to allow the proteins to bind to any receptor present on the cell surface. Following the incubation, the cells are washed to remove non-specifically bound protein. The labeled proteins are detected by autoradiography. Alternatively, unlabeled proteins may be incubated with the cells and detected with antibodies having a detectable label, such as a fluorescent molecule, attached thereto.

Specificity of cell surface binding may be analyzed by conducting a competition analysis in which various amounts of unlabeled protein are incubated along with the labeled protein. The amount of labeled protein bound to the cell surface decreases as the amount of competitive unlabeled protein increases. As a control, various amounts of an unlabeled protein unrelated to the labeled protein is included in some binding reactions. The amount of labeled protein bound to the cell surface does not decrease in binding reactions containing increasing amounts of unrelated unlabeled protein, indicating that the protein encoded by the cDNA binds specifically to the cell surface.

As discussed herein, secreted proteins have been shown to have a number of important physiological effects and, consequently, represent a valuable therapeutic resource. The secreted proteins encoded by the cDNAs or fragments thereof made using any of the methods described therein may be evaluated to determine their physiological activities as described below.

Assaying GENSET Proteins or Fragments thereof for Cytokine, Cell Proliferation or Cell Differentiation Activity Secreted proteins may act as cytokines or may affect cellular proliferation or differentiation. Many protein factors discovered to date, including all known cytokines, have exhibited activity in one or more factor dependent cell proliferation assays, and hence the assays serve as a convenient confirmation of cytokine activity. The activity of a protein of the present invention is evidenced by any one of a number of routine factor dependent cell proliferation assays for cell lines including, without limitation, 32D, DA2, DA1G, T10, B9, B9/11, BaF3, MC9/G, M+ (preB M+), 2E8, RB5, DA1, 123, T1165, HT2, CTLL2, TF-1, Mo7c and CMK. The proteins encoded by the cDNAs of the invention or fragments thereof may be evaluated for their ability to regulate T cell or thymocyte proliferation in assays such as those described above or in the following references, which are incorporated herein by reference: *Current Protocols in Immunology*, Ed. by J. E. Coligan et al., Greene Publishing Associates and Wiley-Interscience; Takai et al. *J. Immunol.* 137:3494-3500, 1986. Bertagnolli et al. *J. Immunol.* 145:1706–1712, 1990. Bertagnolli et al., *Cellular Immunology* 133:327–341, 1991. Bertagnolli, et al. *J. Immunol.* 149:3778–3783, 1992; Bowman et al., *J. Immunol* 152:1756–1761, 1994.

In addition, numerous assays for cytokine production and/or the proliferation of spleen cells, lymph node cells and thymocytes are known. These include the techniques disclosed in *Current Protocols in Immunology*. J. E. Coligan et al. Eds., Vol 1 pp. 3.12.1–3.12.14 John Wiley and Sons, Toronto. 1994; and Schreiber, R. D. *Current Protocols in Immunology.*, supra Vol 1 pp. 6.8.1-6.8.8, John Wiley and Sons, Toronto. 1994.

The proteins encoded by the cDNAs of the invention may also be assayed for the ability to regulate the proliferation and differentiation of hematopoietic or lymphopoietic cells. Many assays for such activity are familiar to those skilled in the art, including the assays in the following references, which are incorporated herein by reference: Bottomly, K., Davis, L. S. and Lipsky, P. E., Measurement of Human and Murine Interleukin 2 and Interleukin 4, *Current Protocols in Immunology.*, J. E. Coligan et al. Eds. Vol 1 pp. 6.3.1–6.3.12, John Wiley and Sons, Toronto. 1991; deVries et al., *J. Exp. Med.* 173:1205–1211, 1991; Moreau et al., *Nature* 36:690–692, 1988; Greenberger et al., *Proc. Natl. Acad. Sci. U.S.A.* 80:2931–2938, 1983; Nordan, R., Measurement of Mouse and Human Interleukin 6 *Current Protocols in Immunology*. J. E. Coligan et al. Eds. Vol 1 pp. 6.6.1–6.6.5, John Wiley and Sons, Toronto. 1991; Smith et al., *Proc. Natl. Acad. Sci. U.S.A.* 83:1857–1861, 1986; Bennett, F., Giannotti, J., Clark, S. C. and Turner, K. J., Measurement of Human Interleukin 11 *Current Protocols in Immunology*. J. E. Coligan et al. Eds. Vol 1 pp. 6.15.1 John Wiley and Sons, Toronto. 1991; Ciarletta, A., Giannotti, J., Clark, S. C. and Turner, K. J., Measurement of Mouse and Human Interleukin 9 *Current Protocols in Immunology*. J. E. Coligan et al., Eds. Vol 1 pp. 6.13.1, John Wiley and Sons, Toronto. 1991.

The proteins encoded by the cDNAs of the invention may also be assayed for their ability to regulate T-cell responses to antigens. Many assays for such activity are familiar to those skilled in the art, including the assays described in the following references, which are incorporated herein by reference: Chapter 3 (In vitro Assays for Mouse Lymphocyte Function), Chapter 6 (Cytokines and Their Cellular Receptors) and Chapter 7, (Immunologic Studies in Humans) in *Current Protocols in Immunology*, J. E. Coligan et al. Eds. Greene Publishing Associates and Wiley-Interscience; Weinberger et al., *Proc. Natl. Acad. Sci. USA* 77:6091–6095, 1980; Weinberger et al., *Eur. J. Immun.* 11:405–411, 1981; Takai et al., *J. Immunol.* 137:3494–3500, 1986; Takai et al., *J. Immunol.* 140:508–512, 1988.

Those proteins which exhibit cytokine, cell proliferation, or cell differentiation activity may then be formulated as pharmaceuticals and used to treat clinical conditions in which induction of cell proliferation or differentiation is beneficial. Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments thereof for Activity as Immune System Regulators The proteins encoded by the cDNAs of the invention may also be evaluated for their effects as immune regulators. For example, the proteins may be evaluated for their activity to influence thymocyte or splenocyte cytotoxicity. Numerous assays for such activity are familiar to those skilled in the art including the assays described in the following references, which are incorporated herein by reference: Chapter 3 (In vitro Assays for Mouse Lymphocyte Function 3.1–3.19) and Chapter 7 (Immunologic studies in Humans) in *Current Protocols in Immunology*, J. E. Coligan et al. Eds, Greene Publishing Associates and Wiley-Interscience; Herrmann et al., *Proc. Natl. Acad. Sci. USA* 78:2488–2492, 1981; Herrmann et al., *J. Immunol.* 128:1968–1974, 1982; Handa et al., *J. Immunol.* 135:1564–1572, 1985; Takai et al., *J. Immunol.* 137:3494–3500, 1986; Takai et al., *J. Immunol.* 140:508–512, 1988; Herrmann et al., *Proc. Natl. Acad. Sci. USA* 78:2488–2492, 1981; Herrmann et al., *J. Immunol.* 128:1968–1974, 1982; Handa et al., *J. Immunol.* 135:1564–1572, 1985; Takai et al., *J. Immunol.* 137:3494–3500, 1986; Bowman et al., *J. Virology* 61:1992–1998; Takai et al., *J. Immunol.* 140:508–512, 1988; Bertagnolli et al., *Cellular Immunology* 133:327–341, 1991; Brown et al., *J. Immunol.* 153:3079–3092, 1994.

The proteins encoded by the cDNAs of the invention may also be evaluated for their effects on T-cell dependent immunoglobulin responses and isotype switching. Numerous assays for such activity are familiar to those skilled in the art, including the assays disclosed in the following references, which are incorporated herein by reference: Maliszewski, *J. Immunol.* 144:3028–3033, 1990; Mond, J. J. and Brunswick, M Assays for B Cell Function: In vitro Antibody Production, Vol 1 pp. 3.8.1–3.8.16 in *Current Protocols in Immunology*. J. E. Coligan et al Eds., John Wiley and Sons, Toronto. 1994.

The proteins encoded by the cDNAs of the invention may also be evaluated for their effect on immune effector cells, including their effect on Th1 cells and cytotoxic lymphocytes. Numerous assays for such activity are familiar to those skilled in the art, including the assays disclosed in the following references, which are incorporated herein by reference: Chapter 3 (In vitro Assays for Mouse Lymphocyte Function 3.1–3.19) and Chapter 7 (Immunologic Studies in Humans) in *Current Protocols in Immunology*, J. E. Coligan et al. Eds., Greene Publishing Associates and Wiley-Interscience; Takai et al., *J. Immunol.* 137:3494–3500, 1986; Takai et al.; *J. Immunol.* 140:508–512, 1988; Bertagnolli et al., *J. Immunol.* 149:3778–3783, 1992.

The proteins encoded by the cDNAs of the invention may also be evaluated for their effect on dendritic cell mediated activation of naive T-cells. Numerous assays for such activity are familiar to those skilled in the art, including the assays disclosed in the following references, which are incorporated herein by reference: Guery et al., *J. Immunol.* 134:536–544, 1995; Inaba et al., *Journal of Experimental Medicine* 173:549–559, 1991; Macatonia et al., *Journal of Immunology* 154:5071–5079, 1995; Porgador et al., *Journal of Experimental Medicine* 182:255–260, 1995; Nair et al., *Journal of Virology* 67:4062–4069, 1993; Huang et al., *Science* 264:961–965, 1994; Macatonia et al., *Journal of Experimental Medicine* 169:1255–1264, 1989; Bhardwaj et al., *Journal of Clinical Investigation* 94:797–807, 1994; and Inaba et al., *Journal of Experimental Medicine* 172:631–640, 1990.

The proteins encoded by the cDNAs of the invention may also be evaluated for their influence on the lifetime of lymphocytes. Numerous assays for such activity are familiar to those skilled in the art, including the assays disclosed in the following references, which are incorporated herein by reference: Darzynkiewicz et al., *Cytometry* 13:795–808, 1992; Gorczyca et al., *Leukemia* 7:659–670, 1993; Gorczyca et al., *Cancer Research* 53:1945–1951, 1993; Itoh et al., *Cell* 66:233–243, 1991; Zacharchuk, *Journal of Immunology* 145:4037–4045, 1990; Zamai et al., Cytometry 14:891–897, 1993; Gorczyca et al., *International Journal of Oncology* 1:639–648, 1992.

Assays for proteins that influence early steps of T-cell commitment and development include, without limitation, those described in: Antica et al., Blood 84:111–117, 1994; Fine et al., Cellular immunology 155:111–122, 1994; Galy et al., Blood 85:2770–2778, 1995; Toki et al., Proc. Nat. Acad Sci. USA 88:7548–7551, 1991.

Those proteins which exhibit activity as immune system regulators activity may then be formulated as pharmaceuticals and used to treat clinical conditions in which regulation of immune activity is beneficial. For example, the protein may be useful in the treatment of various immune deficiencies and disorders (including severe combined immunodeficiency (SCID)), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases caused by viral, bacterial, fungal or other infection may be treatable using a protein of the present invention, including infections by HIV, hepatitis viruses, herpesviruses, mycobacteria, Leishmania spp., malaria spp. and various fungal infections such as candidiasis. Of course, in this regard, a protein of the present invention may also be useful where a boost to the immune system generally may be desirable, i.e., in the treatment of cancer.

Autoimmune disorders which may be treated using a protein of the present invention include, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitus, myasthenia gravis, graft-versus-host disease and autoimmune inflammatory eye disease. Such a protein of the present invention may also to be useful in the treatment of allergic reactions and conditions, such as asthma (particularly allergic asthma) or other respiratory problems. Other conditions, in which immune suppression is desired (including, for example, organ transplantation), may also be treatable using a protein of the present invention.

Using the proteins of the invention it may also be possible to regulate immune responses, in a umber of ways. Down regulation may be in the form of inhibiting or blocking an immune response already in progress or may involve preventing the induction of an immune response. The functions of activated T-cells may be inhibited by suppressing T cell responses or by inducing specific tolerance in T cells, or both. Immunosuppression of T cell responses is generally an active, non-antigen-specific, process which requires continuous exposure of the T cells to the suppressive agent. Tolerance, which involves inducing non-responsiveness or anergy in T cells, is distinguishable from immunosuppression in that it is generally antigen-specific and persists after exposure to the tolerizing agent has ceased. Operationally, tolerance can be demonstrated by the lack of a T cell response upon reexposure to specific antigen in the absence of the tolerizing agent.

Down regulating or preventing one or more antigen functions (including without limitation B lymphocyte antigen functions (such as, for example, B7)), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a molecule which inhibits or blocks interaction of a B7 lymphocyte antigen with its natural ligand(s) on immune cells (such as a soluble, monomeric form of a peptide having B7-2 activity alone or in conjunction with a monomeric form of a peptide having an activity of another B lymphocyte antigen (e.g., B7-1, B7-3) or blocking antibody), prior to transplantation can lead to the binding of the molecule to the natural ligand(s) on the immune cells without transmitting the corresponding costimulatory signal. Blocking B lymphocyte antigen function in this matter prevents cytokine synthesis by immune cells, such as T cells, and thus acts as an immunosuppressant. Moreover, the lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular blocking reagents in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al., Science 257:789–792 (1992) and Turka et al., Proc. Natl. Acad. Sci USA, 89:11102–11105 (1992). In addition, murine models of GVHD (see Paul ed., Fundamental Immunology, Raven Press, New York, 1989, pp. 846–847) can be used to determine the effect of blocking B lymphocyte antigen function in vivo on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block costimulation of T cells by disrupting receptor ligand interactions of B lymphocyte antigens can be used to inhibit T cell activation and prevent production of autoantibodies or T cell-derived cytokines which may be involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythematosis in MRL/pr/pr mice or NZB hybrid mice, murine autoimmuno collagen arthritis, diabetes mellitus in OD mice and BB rats, and murine experimental myasthenia gravis (see Paul ed., Fundamental Immunology, Raven Press, New York, 1989, pp. 840–856).

Upregulation of an antigen function (preferably a B lymphocyte antigen function), as a means of up regulating immune responses, may also be useful in therapy. Upregulation of immune responses may be in the form of enhancing an existing immune response or eliciting an initial immune response. For example, enhancing an immune response through stimulating B lymphocyte antigen function may be useful in cases of viral infection. In addition, systemic viral diseases such as influenza, the common cold, and encephalitis might be alleviated by the administration of stimulatory form of B lymphocyte antigens systemically.

Alternatively, anti-viral immune responses may be enhanced in an infected patient by removing T cells from the patient, costimulating the T cells in vitro with viral antigen-pulsed APCs either expressing a peptide of the present invention or together with a stimulatory form of a soluble peptide of the present invention and reintroducing the in vitro activated T cells into the patient. The infected cells would now be capable of delivering a costimulatory signal to T cells in vivo, thereby activating the T cells.

In another application, up regulation or enhancement of antigen function (preferably B lymphocyte antigen function) may be useful in the induction of tumor immunity. Tumor cells (e.g., sarcoma, melanoma, lymphoma, leukemia, neuroblastoma, carcinoma) transfected with a nucleic acid encoding at least one peptide of the present invention can be administered to a subject to overcome tumor-specific tolerance in the subject. If desired, the tumor cell can be transfected to express a combination of peptides. For example, tumor cells obtained from a patient can be transfected ex vivo with an expression vector directing the expression of a peptide having B7-2-like activity alone, or in conjunction with a peptide having B7-1-like activity and/or B7-3-like activity. The transfected tumor cells are returned to the patient to result in expression of the peptides on the surface of the transfected cell. Alternatively, gene therapy techniques can be used to target a tumor cell for transfection in vivo.

The presence of the peptide of the present invention having the activity of a B lymphocyte antigen(s) on the surface of the tumor cell provides the necessary costimulation signal to T cells to induce a T cell mediated immune response against the transfected tumor cells. In addition, tumor cells which lack MHC class I or MHC class II molecules, or which fail to reexpress sufficient amounts of MHC class I or MHC class II molecules, can be transfected with nucleic acids encoding all or a fragment of (e.g., a cytoplasmic-domain truncated fragment) of an MHC class I α chain protein and $β_2$ microglobulin protein or an MHC class II α chain protein and an MHC class II β chain protein to thereby express MHC class I or MHC class II proteins on the cell surface. Expression of the appropriate class II or class II MHC in conjunction with a peptide having the activity of a B lymphocyte antigen (e.g., B7-1, B7-2, B7-3) induces a T cell mediated immune response against the transfected tumor cell. Optionally, a gene encoding an antisense construct which blocks expression of an MHC class II associated protein, such as the invariant chain,can also be cotransfected with a DNA encoding a peptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject. Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments Thereof for Hematopoiesis Regulating Activity The proteins encoded by the cDNAs of the invention or fragments thereof may also be evaluated for their hematopoiesis regulating activity. For example, the effect of the proteins on embryonic stem cell differentiation may be evaluated. Numerous assays for such activity are familiar to those skilled in the art, including the assays disclosed in the following references, which are incorporated herein by reference: Johansson et al. *Cellular Biology* 15:141–151, 1995; Keller et al., *Molecular and Cellular Biology* 13:473–486, 1993; McClanahan et al., *Blood* 81:2903–2915, 1993.

The proteins encoded by the cDNAs of the invention or fragments thereof may also be evaluated for their influence on the lifetime of stem cells and stem cell differentiation. Numerous assays for such activity are familiar to those skilled in the art, including the assays disclosed in the following references, which are incorporated herein by reference: Freshney, M. G. Methylcellulose Colony Forming Assays, in *Culture of Hematopoietic Cells*. R. I. Freshney, et al. Eds. pp. 265–268, Wiley-Liss, Inc., New York, N.Y. 1994; Hirayama et al., *Proc. Natl. Acad. Sci. USA* 89:5907–5911, 1992; McNiece, I. K. and Briddell, R. A. Primitive Hematopoietic Colony Forming Cells with High Proliferative Potential, in *Culture of Hematopoietic Cells*. R. I. Freshney, et al. eds. Vol pp. 23–39, Wiley-Liss, Inc., New York, N.Y. 1994; Neben et al., *Experimental Hematology* 22:353–359, 1994; Ploemacher, R. E. Cobblestone Area Forming Cell Assay, In *Culture of Hematopoietic Cells*. R. I. Freshney, et al. Eds. pp. 1–21, Wiley-Liss, Inc., New York, N.Y. 1994; Spooncer, E., Dexter, M. and Allen, T. Long Term Bone Marrow Cultures in the Presence of Stromal Cells, in *Culture of Hematopoietic Cells*. R. I. Freshney, et al. Eds. pp. 163–179, Wiley-Liss, Inc., New York, N.Y. 1994; and Sutherland, H. J. Long Term Culture Initiating Cell Assay, in *Culture of Hematopoietic Cells*. R. I. Freshney, et al. Eds. pp. 139–162, Wiley-Liss, Inc., New York, N.Y. 1994.

Those proteins which exhibit hematopoiesis regulatory activity may then be formulated as pharmaceuticals and used to treat clinical conditions in which regulation of hematopoeisis is beneficial. For example, a protein of the present invention may be useful in regulation of hematopoiesis and, consequently, in the treatment of myeloid or lymphoid cell deficiencies. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelo-suppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantion, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy. Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments thereof for Regulation of Tissue Growth

The proteins encoded by the cDNAs of the invention or fragments thereof may also be evaluated for their effect on tissue growth. Numerous assays for such activity are familiar to those skilled in the art, including the assays disclosed in International Patent Publication No. WO95/16035, International Patent Publication No. WO95/05846 and International Patent Publication No. WO91/07491, which are incorporated herein by reference.

Assays for wound healing activity include, without limitation, those described in: Winter, *Epidermal Wound Healing*, pps. 71–112 (Maibach, H1 and Rovee, D T, eds.), Year Book Medical Publishers, Inc., Chicago, as modified by Eaglstein and Mertz, J. Invest. Dermatol 71:382–84 (1978) which are incorporated herein by reference.

Those proteins which are involved in the regulation of tissue growth may then be formulated as pharmaceuticals and used to treat clinical conditions in which regulation of tissue growth is beneficial. For example, a protein of the present invention also may have utility in compositions used for bone, cartilage, tendon, ligament and/or nerve tissue growth or regeneration, as well as for wound healing and tissue repair and replacement, and in the treatment of burns, incisions and ulcers.

A protein of the present invention, which induces cartilage and/or bone growth in circumstances where bone is not normally formed, has application in the healing of bone fractures and cartilage damage or defects in humans and other animals. Such a preparation employing a protein of the invention may have prophylactic use in closed as well as open fracture reduction and also in the improved fixation of artificial joints. De novo bone formation induced by an osteogenic agent contributes to the repair of congenital, trauma induced, or oncologic resection induced craniofacial defects, and also is useful in cosmetic plastic surgery.

A protein of this invention may also be used in the treatment of periodontal disease, and in other tooth repair processes. Such agents may provide an environment to attract bone-forming cells, stimulate growth of bone-forming cells or induce differentiation of progenitors of bone-forming cells. A protein of the invention may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes.

Another category of tissue regeneration activity that may be attributable to the protein of the present invention is tendon/ligament formation. A protein of the present invention, which induces tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the present invention contributes to the repair of congenital, trauma induced, or other tendon or ligament defects of other origin, and is also useful in cosmetic plastic surgery for attachment or repair of tendons or ligaments. The compositions of the present invention may provide an environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The compositions of the invention may also be useful in the treatment of tendinitis, carpal tunnel syndrome and other tendon or ligament defects. The compositions may also include an appropriate matrix and/or sequestering agent as a carrier as is well known in the art.

The protein of the present invention may also be useful for proliferation of neural cells and for regeneration of nerve and brain tissue, i.e., for the treatment of central and peripheral nervous system diseases and neuropathies, as well as mechanical and traumatic disorders, which involve degeneration, death or trauma to neural cells or nerve tissue. More specifically, a protein may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a protein of the invention.

Proteins of the invention may also be useful to promote better or faster closure of non-healing wounds, including without limitation pressure ulcers, ulcers associated with vascular insufficiency, surgical and traumatic wounds, and the like.

It is expected that a protein of the present invention may also exhibit activity for generation or regeneration of other tissues, such as organs (including, for example, pancreas, liver, intestine, kidney, skin, endothelium) muscle (smooth, skeletal or cardiac) and vascular (including vascular endothelium) tissue, or for promoting the growth of cells comprising such tissues. Part of the desired effects may be by inhibition or modulation of fibrotic scarring to allow normal tissue to generate. A protein of the invention may also exhibit angiogenic activity.

A protein of the present invention may also be useful for gut protection or regeneration and treatment of lung or liver fibrosis, reperfusion injury in various tissues, and conditions resulting from systemic cytokine damage.

A protein of the present invention may also be useful for promoting or inhibiting differentiation of tissues described above from precursor tissues or cells; or for inhibiting the growth of tissues described above.

Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments Thereof for Regulation of Reproductive Hormones or Cell Movement The proteins encoded by the cDNAs of the invention or fragments thereof may also be evaluated for their ability to regulate reproductive hormones, such as follicle stimulating hormone. Numerous assays for such activity are familiar to those skilled in the art, including the assays disclosed in the following references, which are incorporated herein by reference: Vale et al., *Endocrinology* 91:562–572, 1972; Ling et al., *Nature* 321:779–782, 1986; Vale et al., *Nature* 321:776–779, 1986; Mason et al., *Nature* 318:659–663, 1985; Forage et al., *Proc. Natl. Acad. Sci. USA* 83:3091–3095, 1986. Chapter 6.12 (Measurement of Alpha and Beta Chemokines) *Current Protocols in Immunology*, J. E. Coligan et al. Eds. Greene Publishing Associates and Wiley-Intersciece; Taub et al. *J. Clin. Invest.* 95:1370–1376, 1995; Lind et al. *APMIS* 103:140–146, 1995; Muller et al. i Eur. J. Immunol. 25:1744–1748; Gruber et al. *J. of Immunol.* 152:5860–5867, 1994; Johnston et al. *J. of Immunol.* 153:1762–1768, 1994.

Those proteins which exhibit activity as reproductive hormones or regulators of cell movement may then be formulated as pharmaceuticals and used to treat clinical conditions in which regulation of reproductive hormones or cell movement are beneficial. For example, a protein of the present invention may also exhibit activin- or inhibin-related activities. Inhibins are characterized by their ability to inhibit the release of follicle stimulating hormone (FSH), while activins are characterized by their ability to stimulate the release of folic stimulating hormone (FSH). Thus, a protein of the present invention, alone or in heterodimers with a member of the inhibin a family, may be useful as a contraceptive based on the ability of inhibins to decrease fertility in female mammals and decrease spermatogenesis in male mammals. Administration of sufficient amounts of other inhibins can induce infertility in these mammals. Alternatively, the protein of the invention, as a homodimer or as a heterodimer with other protein subunits of the inhibin-B group, may be useful as a fertility inducing therapeutic, based upon the ability of activin molecules in stimulating FSH release from cells of the anterior pituitary. See, for example, U.S. Pat. No. 4,798,885, the disclosure of which is incorporated herein by reference. A protein of the invention may also be useful for advancement of the onset of fertility in sexually immature mammals, so as to increase the lifetime reproductive performance of domestic animals such as cows, sheep and pigs.

Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments Thereof for Chemotactic/Chemokinetic Activity The proteins encoded by the cDNAs of the invention or fragments thereof may also be evaluated for chemotactic/chemokinetic activity. For example, a protein of the present invention may have chemotactic or chemokinetic activity (e.g., act as a chemokine) for mammalian cells, including, for example, monocytes, fibroblasts, neutrophils, T-cells, mast cells, cosinophils, epithelial and/or endothelial cells. Chemotactic and chmokinetic proteins can be used to mobilize or attract a desired cell population to a desired site of action. Chemotactic or chemokinetic proteins provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or peptide has chemotactic activity for a particular cell population if it can stimulate, directly or indirectly, the directed orientation or movement of such cell population. Preferably, the protein or peptide has the ability to directly stimulate directed movement of cells. Whether a particular protein has chemotactic activity for a population of cells can be readily determined by employing such protein or peptide in any known assay for cell chemotaxis.

The activity of a protein of the invention may, among other means, be measured by the following methods:

Assays for chemotactic activity (which will identify proteins that induce or prevent chemotaxis) consist of assays that measure the ability of a protein to induce the migration of cells across a membrane as well as the ability of a protein to induce the adhension of one cell population to another cell population. Suitable assays for movement and adhesion include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 6.12, Measurement of alpha and beta Chemokines 6.12.1–6.12.28; Taub et al. J. Clin. Invest. 15 95:1370–1376, 1995; Lind et al. APMIS 103:140–146, 1995; Mueller et al Eur. J. Immunol. 25:1744–1748; Gruber et al. J. of Immunol. 152:5860–5867, 1994; Johnston et al. J. of Immunol, 153:1762–1768, 1994.

Assaying GENSET Proteins or Fragments Thereof for Regulation of Blood Clotting

The proteins encoded by the cDNAs of the invention or fragments thereof may also be evaluated for their effects on blood clotting. Numerous assays for such activity are familiar to those skilled in the art, including the assays disclosed in the following references, which are incorporated herein by reference: Linet et al., *J. Clin. Pharmacol*. 26:131–140, 1986; Burdick et al., *Thrombosis Res*. 45:413–419, 1987; Humphrey et al., *Fibrinolysis* 5:71–79 (1991); Schaub, *Prostaglandins* 35:467–474, 1988.

Those proteins which are involved in the regulation of blood clotting may then be formulated as pharmaceuticals and used to treat clinical conditions in which regulation of blood clotting is beneficial. For example, a protein of the invention may also exhibit hemostatic or thrombolytic activity. As a result, such a protein is expected to be useful in treatment of various coagulations disorders (including hereditary disorders, such as hemophilias) or to enhance coagulation and other hemostatic events in treating wounds resulting from trauma, surgery or other causes. A protein of the invention may also be useful for dissolving or inhibiting formation of thromboses and for treatment and prevention of conditions resulting therefrom (such as, for example, infarction of cardiac and central nervous system vessels (e.g., stroke)). Alternatively, as described in more detail below, genes encoding these proteins or nucleic acids regulating the expression of these proteins may be introduced into appropriate host cells to increase or decrease the expression of the proteins as desired.

Assaying GENSET Proteins or Fragments Thereof for Involvement in Receptor/Ligand Interactions The proteins encoded by the cDNAs or a fragment thereof may also be evaluated for their involvement in receptor/ligand interactions. Numerous assays for such involvement are familiar to those skilled in the art, including the assays disclosed in the following references, which are incorporated herein by reference: Chapter 7.28 (Measurement of Cellular Adhesion under Static Conditions 7.28.1–7.28.22) in *Current Protocols in Immunology*, J. E. Coligan et al. Eds. Greene Publishing Associates and Wiley-Interscience; Takai et al., *Proc. Natl. Acad. Sci. USA* 84:6864–6868, 1987; Bierer et al., *J. Exp. Med*. 168:1145–1156, 1988; Rosenstein et al., *J. Exp. Med*. 169:149–160, 1989; Stoltenborg et al., *J. Immunol. Methods* 175:59–68, 1994; Stitt et al., *Cell* 80:661–670, 1995; Gyuris et al., *Cell* 75:791–803, 1993.

For example, the proteins of the present invention may also demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selecting, integrins and their ligands) and receptor/ligand pairs involved in antigen presentation, antigen recognition and development of cellular and humoral immune respones). Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

Assaying GENSET Proteins or Fragments Thereof for Anti-Inflammatory Activity

The proteins encoded by the cDNAs or a fragment thereof may also be evaluated for anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Proteins exhibiting such activities can be used to treat inflammatory conditions including chronic or acute conditions), including without limitation inflammation associated with infection (such as septic shock, sepsis or systemic inflammatory response syndrome (SIRS)), ischemia-reperfusioninury, endotoxin lethality, arthritis, complement-mediated hyperacute rejection, nephritis, cytokine or chemokine-induced lung injury, inflammatory bowel disease, Crohn's disease or resulting from over production of cytokines such as TNF or IL-1. Proteins of the invention may also be useful to treat anaphylaxis and hypersensitivity to an antigenic substance or material.

Assaying GENSET Proteins or Fragments Thereof for Tumor Inhibition Activity

The proteins encoded by the cDNAs of the invention or a fragment thereof may also be evaluated for tumor inhibition activity. In addition to the activities described above for immunological treatment or prevention of tumors, a protein of the invention may exhibit other anti-tumor activities. A protein may inhibit tumor growth directly or indirectly (such as, for example, via ADCC). A protein may exhibit its tumor inhibitory activity by acting on tumor tissue or tumor precursor tissue, by inhibiting formation of tissues necessary to support tumor growth (such as, for example, by inhibiting angiogenesis), by causing production of other factors, agents or cell types which inhibit tumor growth, or by suppressing, eliminating or inhibiting factors, agents or cell types which promote tumor growth.

A protein of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, cofactors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein.

REFERENCES

Abbondanzo et al., (1993), *Meth. Enzymol.*, Academic Press, New York, pp 803–823

Altschul et al., (1990), *J. Mol. Biol.* 215(3):403–410

Altschul et al., (1993), *Nature Genetics* 3:266–272

Altschul et al., (1997), *Nuc. Acids Res.* 25:3389–3402

Ames et al., (1995), *J. Immunol. Meth.* 184:177–186.

Anton and Graham, (1995), *J. Virol.*, 69:4600–4606

Araki et al., (1995) Proc. Natl. Acad. Sci. USA. 92(1):160–4.

Ashkenazi et al., (1991), Proc. Natl. Acad. Sci. USA 88:10535–10539.

Aszódi et al., (1997) Proteins: Structure, Function, and Genetics, Supplement 1:38–42

Attwood et al., (1996) Nucleic Acids Res. 24(1):182–8.

Attwood et al., (2000) Nucleic Acids Res. 28(1):225–7

Bartunek et al., (1996), *Cytokine.* 8(1):14–20.

Bateman et al., (2000) Nucleic Acids Res. 28(1):263–6

Baubonis (1993) *Nucleic Acids Res.* 21(9):2025–9.

Beaucage et al., (1981) *Tetrahedron Lett*, 22: 1859–1862

Benham et al. (1989) *Genomics* 4:509–517,

Better et al., (1988), *Science.* 240:1041–1043.

Bhagwat et al. (1999) *J. Biol. Chem.* 274:24014–22

Bittle et al., (1985), *Virol.* 66:2347–2354.

Bowie et al., (1994), Science. 247:1306–1310.

Bradley (1987), Production and analysis of chimaeric mice. In: E. J. Robertson (Ed.), Teratocarcinomas and embryonic stem cells: A practical approach. IRL Press, Oxford, pp.113.

Bram et al., (1993), *Mol. Cell Biol.*, 13:4760–4769

Brinkman et al., (1995) *J. Immunol Methods.* 182:41–50.

Brown et al., (1979) *Meth. Enzymol.* 68:109–151

Brutlag et al. (1990) *Comp. App. Biosci.* 6:237–245

Bucher and Bairoch (1994) Proceedings 2nd International Conference on Intelligent Systems for Molecular Biology. Altman et al, Eds., pp53–61, AAAlPress, Menlo Park.

Burton et al. (1994), *Adv. Immunol.* 57:191–280

Bush et al., (1997), J. Chromatogr., 777:311–328.

Butt and Karathanasis (1995) *Gene Expr.* 4(6):319–36.

Carlson et al., (1997), *J. Biol. Chem.* 272(17):11295–11301.

Chai et al., (1993) Biotechnol. Appl. Biochem. 18:259–273.

Chang et al., (1993) *Gene* 127:95–8

Chee et al., (1996) *Science.* 274:610–614.

Chen et al. (1987) *Mol. Cell. Biol.* 7:2745–2752.

Chen et al., (1998), *Cancer Res.* 58(16):3668–3678.

Cherif et al., (1990) Proc. Natl. Acad. Sci. U.S.A., 87:6639–6643

Cho et al., (1998), *Proc. Natl. Acad. Sci. USA*, 95(7): 3752–3757.

Chou, (1989), *Mol. Endocrinol.* 3:1511–1514.

Chow et al., (1985), Proc. Natl. Acad. Sci. USA. 82:910–914.

Christophe et al. (2000) *Cell Signal* 12(5):337–41

Ciminale et al. (1999) *Oncogene* 18:4505–14

Cleland et al., (1993), Crit. Rev. Therapeutic Drug Carrier Systems. 10:307–377.

Coles et al., (1998) *Hum Mol Genet* 7:791–800

Compton (1991) *Nature.* 350(6313):91–92.

Corpet et al. (2000) Nucleic Acids Res. 28(1):267–9

Cox et al., (1990) *Science* 250:245–250

Creighton (1983), Proteins: Structures and Molecular Principles, W. H. Freeman & Co. 2nd Ed., T. E., New York Creighton, (1993), Posttranslational Covalent Modification of Proteins, W. H. Freeman and Company, New York B. C. Johnson, Ed., Academic Press, New York 1–12

Cunningham et al. (1989), Science 244:1081–1085.

Davis et al., (1986) Basic Methods in Molecular Biology, ed., Elsevier Press, NY, Decker and Parker, (1995) Curr. Opin. Cell. Biol. 7(3):368–92

Dempster et al., (1977) Stat. Soc., 39B:1–38.

Deng et al., (1998) Blood. 92(6):1981–1988.

Dent and Latchman (1993) The DNA mobility shift assay. In: Transcription Factors: A Practical Approach (Latchman DS, ed.) pp1–26. Oxford: IRL Press Derrigo et al., (2000) Int. J. Mol. Med. 5(2):111–23

Eckner et al., (1991) EMBO J. 10:3513–3522.

Edwards and Leatherbarrow, (1997) Analytical Biochemistry, 246, 1–6

Engvall, (1980) Meth. Enzymol. 70:419

Erlich, (1992) PCR Technology; Principles and Applications for DNA Amplification. W. H. Freeman and Co., New York Essl et al., (1999) *FEBS Lett*. 453:169–73.

Feldman and Steg, (1996), Medecine/Sciences, 12:47–55

Felgner (1996) Hum Gene Ther. 7(15):1791–3.

Felici, (1991), J. Mol. Biol., 222:301–310

Fell et al., (1991), J. Immunol. 146:2446–2452.

Fields and Song, (1989), Nature, 340: 245–246

Fisher, (1980) Chap. 42 in: Manual of Clinical Immunology, 2d Ed. (Rose and Friedman, Eds.) Amer. Soc. For Microbiol., Washington, D.C.

Flotte et al., (1992) Am. J. Respir. Cell Mol. Biol. 7:349–356.

Fodor et al., (1991) Science 251:767–777.

Foster et al., (1996) Genomics 33:185–192

Fountoulakis et al., (1995) Biochem. 270:3958–3964.

Fraley et al., (1979) Proc. Natl. Acad. Sci. USA. 76:3348–3352.

Frazer et al., (1992) Genomics 14:574–584

Fried and Crothers, (1981) Nucleic Acids Res. 9:6505–6525

Fromont-Racine et al., (1997), Nature Genetics, 16(3): 277–282.

Fry et al., (1992) Biotechniques, 13:124–131

Fudenberg, (1980) Chap. 26 in: Basic 503 Clinical Immunology, 3rd Ed. Lange, Los Altos, Calif.

Fuller S. A. et al. (1996) Immunology in Current Protocols in Molecular Biology, Furth P. A. et al. (1994) Proc. Natl. Acad. Sci USA. 91:9302–9306.

Garner and Revzin, (1981) Nucleic Acids Res 9:3047–3060

Gentz et al., (1989) Proc Natl Acad Sci USA. 86(3):821–4.

Geysen et al., (1984), Proc. Natl. Acad. Sci. U.S.A. 81:3998–4002.

Ghosh and Bacchawat, (1991), Targeting of liposomes to hepatocytes, IN: Liver Diseases, Targeted diagnosis and therapy using specific rceptors and ligands. Eds., Marcel Dekeker, New York, pp. 87–104.

Gillies et al., (1989), J. Immunol Methods. 125:191–202.

Gillies et al., (1992), Proc Natl Acad Sci USA 89:1428–1432.

Glaser et al. (1998) *Plant Mol Biol* 38:311–38;

Gonnet et al., (1992), Science 256:1443–1445

Gopal (1985) Mol. Cell. Biol., 5:1188–1190.

Gossen et al., (1992) Proc. Natl. Acad. Sci. USA. 89:5547–5551.

Gossen et al., (1995) Science. 268:1766–1769.

Graham et al., (1973) Virol. 52:456–457.

Green et al., (1986) Ann. Rev. Biochem. 55:569–597

Greenspan and Bona (1989), FASEB J. 7(5):437–444.

Griffais et al., (1991) Nucleic Acids Res. 19:3887–3891

Griffin et al., (1989) Science 245:967–971

Gu H. et al., (1993) Cell 73:1155–1164.

Gu H. et al., (1994) Science 265:103–106.

Guatelli et al., (1990) Proc. Natl. Acad. Sci. USA. 35:273–286.

Gyuris et al., (1993) Cell 75:791–803

Hames and Higgins (1985) Nucleic Acid Hybridization: A Practical Approach. Hames and Higgins Ed., IRL Press, Oxford.

Hammerling (1981), Monoclonal Antibodies and T-Cell Hybridomas, Elsevier, N.Y. 563–681.

Hansson et al., (1999), J. Mol. Biol. 287:265–276.

Haravama (1998), Trends Biotechnol. 16(2):76–82.

Harland et al., (1985) J. Cell. Biol. 101:1094–1095.

Harlow and Lane, (1988) Antibodies A Laboratory Manual. Cold Spring Harbor Laboratory. pp. 53–242

Harper et al., (1993), Cell, 75: 805–816

Harrop et al., (1998), J. Immunol. 161(4):1786–1794.

Haynes et al., (1996) J Biotechnol. 44(1–3):37–42.

Henikoff and Henikoff, (1993), Proteins 17:49–61

Henikoff et al., (2000) Electrophoresis 21(9): 1700–6

Henikoff et al., (2000) Nucleic Acids Res. 28(1):228–30

Herman and Neupert, (2000) Curr. Opinion Microbiol. 3:210–4

Higgins et al., (1996), Meth. Enzymol. 266:383–402

Hillier and Green (1991) PCR Methods Appl., 1:124–8.

Hoess et al., (1986) Nucleic Acids Res. 14:2287–2300.

Hofmann et al., (1999) Nucl. Acids Res. 27:215–219.;

Holm and Sander (1996) Nucleic Acids Res. 24(1):206–9

Holm and Sander (1997) Nucleic Acids Res. 25(1):231–4

Holm and Sander (1999) Nucleic Acids Res. 27(1):244–7

Hoppe et al., (1994), FEBS Letters. 344:191.

Houghten (1985), Proc. Natl. Acad. Sci. USA 82:5131–5135.

Huang et al., (1996) Cancer Res 56(5):1137–1141.

Hunkapiller et al., (1984) Nature. 310(5973):105–11.

Huston et al., (1991), Meth. Enymol. 203:46_88.

Huygen et al., (1996) Nature Medicine. 2(8):893–898.

Izant and Weintraub, (1984) Cell 36(4):1007–15

Jameson and Wolf, (1988), Comp. Appl. Biosci. 4:181–186

Julan et al., (1992) J. Gen. Virol. 73:3251–3255.

Kanegae et al., (1995) Nucl. Acids Res. 23:3816–3821.

Karlin and Altschul, (1990), Proc. Natl. Acad. Sci. USA 87:2267–2268

Kettleborough et al., (1994), Eur. L Immunol. 24:952–958.

Kim U-J. et al., (1996) Genomics 34:213–218.

Klein et al., (1987) Nature. 327:70–73.

Kohler and Milstein, (1975) Nature 256:495

Koller et al.; (1992) Annu. Rev. Immunol. 10:705–730.

Kostelny et al., (1992), J. Immunol. 148:1547–1553.

Landschulz et al., (1988), Science. 240:1759.

Ledbetter et al., (1990) Genomics 6:475–481

Lenhard et al., (1996) Gene. 169:187–190.

Levy et al., (1996) Gene Ther. 3(3):201–11.

Lewin, (1989), Proc. Natl. Acad. Sci. USA 86:9832–8935.

Liautard et al., (1997), Cytokine. 9(4):233–241.

Linton et al., (1993) J. Clin. Invest. 92:3029–3037.

Liu et al., (1994) Proc. Natl. Acad. Sci. USA. 91: 4528–4262.

Lo Conte et al., (2000) Nucleic Acids Res. 28(1):257–9.

Lockhart et al., (1996) Nature Biotechnology 14: 1675–1680

Lorenzo and Blasco (1998) Biotechniques. 24(2):308–313.

Lucas (1994), In: Development and Clinical Uses of Haempophilus b Conjugate;

Luetterforst et al., (1999) *J. Cell. Biol.* 145:1443–59

Makrides, (1999) Protein Expr. Purif. 17(2):183–202

Malik et al., (1992), Exp. Hematol. 20:1028–1035.

Mansour et al., (1988) Nature. 336:348–352.

Marshall et al., (1994) PCR Methods and Applications. 4:80–84.

Maurer et al., (1999) Mol Membr Biol. 16(1):129–40.

McCormick et al., (1994) Genet. Anal. Tech. Appl. 11:158–164.

McLaughlin et al., (1996) Am. J. Hum. Genet. 59:561–569.

Miller and Whelan, (1997) Hum Gene Ther. 8(7):803–15.

Muller et al., (1998), Structure. 6(9):1153–1167.

Mullinax et al., (1992), BioTechniques. 12(6):864–869.

Munro, (1998) *Trends Cell Biol.* 8:11–15

Munro and Pelham (1987) *Cell* 48(5):899–907

Murphy (1997) *Trends Biotechnol.* 15:326–30

Murvai et al., (2000) Nucleic Acids Res. 28(1):260–2

Murzin et al., (1995) J Mol Biol. 247(4):536–40

Muzyczka et al., (1992) Curr. Topics in Micro. and Immunol. 158:97–129.

Nada et al., (1993) Cell 73:1125–1135.

Nagaraja et al, (1997. Genome Research 7:210–222

Nagy et al., (1993), Proc. Natl. Acad. Sci. USA 90: 8424–8428.

Nakai and Horton, (1999) Trends Biochem. Sci., 24:34–36

Nakai and Kanehisa (1992) Genomics 14, 897–911

Naramura et al., (1994), Immunol. Lett. 39:91–99.

Narang et al., (1979), Methods Enzymol 68:90–98

Neda et al., (1991) J. Biol. Chem. 266:14143–14146.

Nevill-Manning et al., (1998) Proc. Natl. Acad. Sci. USA. 95, 5865–5871

Nicolau et al., (1982) Biochim. Biophys. Acta. 721:185–190.

Nicolau et al., (1987), Meth. Enzymol., 149:157–76.

Nissinoff, (1991), J. Immunol. 147(8): 2429–2438.

O'Reilly et al., (1992) Baculovirus Expression Vectors: A Laboratory Manual. W. H. Freeman and Co., New York.

Obermayr et al., (1996) Eur. J. Hum. Genet. 4:242–245

Ohno et al., (1994) Science. 265:781–784.

Oi et al., (1986), BioTechniques 4:214.

Oldenburg et al., (1992), Proc. Natl. Acad. Sci. USA 89:5393–5397.

Orengo et al., (1997) Structure. 5(8):1093–108

Ouchterlony et al., (1973) Chap. 19 in: Handbook of Experimental Immunology D. Wier (ed) Blackwell Padlan, (1991), Molec. Immunol. 28(4/5):489–498.

Parmley and Smith, (1988) Gene 73:305–318

Patten, et al. (1997), Curr Opinion Biotechnol. 8:724–733.

Pearl et al., (2000) Biochem Soc Trans. 28(2):269–75

Pearson and Lipman, (1988), Proc. Natl. Acad. Sci. USA 85(8):2444–2448

Pease and William, (1990), Exp. Cell. Res. 190: 209–211.

Pelham (1990) *Trends Biochem Sci* 12:483–6

Persic et al., (1997), Gene. 1879–81

Pesole et al., (2000) Nucleic Acids Res, 28(1):193–196

Peterson et al., (1993), Proc. Natl. Acad. Sci. USA, 90: 7593–7597.

Picetti and Borrelli, (2000) *Exp Cell Res* 255:258–69

Pidoux and Armstrong (1992) *EMBO J* April;11(4):1583–91

Pietu et al., (1996) Genome Research 6:492–503

Pinckard et al., (1967), Clin. Exp. Immunol 2:331–340.

Pitard et al., (1997), J. Immunol. Methods. 205(2):177–190.

Pongor et al. (1993) Protein Eng. 6(4):391–5

Potter et al., (1984) Proc. Natl. Acad. Sci. U.S.A. 81(22):7161–7165.

Prat et al., (1998), J. Cell. Sci. 111(Pt2):237–247.

Raeymaekers et al., (1995) Genomics 29:170–178

Ramunsen et al., (1997), Electrophoresis, 18: 588–598.

Rattan et al., (1992) Ann NY Acad Sci 663:48–62

Reid et al., (1990) Proc. Natl. Acad. Sci. U.S.A. 87:4299–4303.

Robbins et al., (1987), Diabetes. 36:838–845.

Robertson, (1987), Embryo-derived stem cell lines. In: E. J. Robertson Ed. Teratocarcinomas and embrionic stem cells: a practical approach. IRL Press, Oxford, pp. 71.

Roguska et al., (1994), Proc. Natl. Acad. Sci. U.S.A. 91:969–973.

Ron et al., (1993), Biol Chem., 268 2984–2988.

Rose et al., (1980) Chap. 12 in: Methods in Immunodiagnosis, 2d Ed. John Wiley 503 Sons, New York Rossi et al., (1991) Pharmacol. Ther. 50:245–254, Roth et al., (1996) Nature Medicine. 2(9):985–991.

Roux et al., (1989) Proc. Natl. Acad. Sci. U.S.A. 86:9079–9083.

Sambrook et al., (1989) Molecular Cloning: A Laboratory Manual. 2ed. Cold Spring Harbor Laboratory, Cold Spring Harbor, N.Y.

Samson et al., (1996) Nature, 382(6593):722–725.

Samulski et al., (1989) J. Virol. 63:3822–3828.

Sanchez-Pescador (1988) J. Clin. Microbiol. 26(10):1934–1938.

Sander and Schneider (1991) Proteins. 9(1):56–68.)

Sauer et al., (1988) Proc. Natl. Acad. Sci. U.S.A. 85:5166–5170.

Sawai et al., (1995), AJRI 34:26–34.

Schedl et al., (1993b), Nucleic Acids Res., 21: 4783–4787.

Schedl et al., 1(993a), Nature, 362: 258–261.

Schena et al. (1995) Science 270:467–470

Schena et al., (1996), Proc Natl Acad Sci USA,.93(20):10614–10619.

Schuler et al., (1996) Science 274:540–546

Schultz et al., (1998) Proc Natl Acad Sci USA 95, 5857–5864

Schwartz and Dayhoff, (1978), eds., Matrices for Detecting Distance Relationships: Atlas of Protein Sequence and Structure, Washington: National Biomedical Research Foundation Sczakiel et al., (1995) Trends Microbiol. 3(6):213–217.

Seifter et al., (1990) Meth Enzymol 182:626–646

Shay et al., (1991), Biochem. Biophys. Acta, 1072: 1–7.

Shizuya et al., (1992) Proc. Natl. Acad. Sci. U.S.A. 89:8794–8797.

Shu et al., (1993), Proc. Natl. Acad. Sci. U.S.A. 90:7995–7999.

Skerra et al., (1988), Science 240:1038–1040.

Smith and Johnson (1988) Gene. 67(1):31–40.

Smith et al., (1983) Mol. Cell. Biol. 3:2156–2165.

Smith et al., (1996) Antiviral Res. 32(2):99–115.

Sonnhammer and Kahn D (1994) Protein Sci. 3(3):482–92

Sonnhammer et al., (1997) Proteins. 28(3):405–20

Sosnowski, et al., (1997) Proc Natl Acad Sci USA 94:1119–1123

Sowdhamini et al., (1997) Protein Engineering 10:207, 215

Sternberg (1994) Mamm. Genome. 5:397–404.

Sternberg (1992) Trends Genet. 8:1–16.

Sternberg et al., (1999) Curr Opin Struct Biol. 9(3):368–73.

Stone et al., (2000) J Endocrinol. 164(2):103–18.

Stryer, (1995) Biochemistry, 4th edition

Studnicka et al., (1994), Protein Engineering. 7(6):805–814.

Sutcliffe et al., (1983), Science. 219:660–666.

Szabo et al., (1995) Curr Opin Struct Biol 5, 699–705

Tacson et al., (1996) Nature Medicine. 2(8):888–892.

Taryman et al., (1995), Neuron. 14(4):755–762.

Tatusov et al., (1997) Science, 278, 631:637

Tatusov et al., (2000) Nucleic Acids Res. 28(1):33–6.)

Te Riele et al., (1990) Nature. 348:649–651.

Thomas et al., (1986) Cell. 44:419–428.

Thomas et al., (1987) Cell. 51:503–512.

Thompson et al., (1994), Nucleic Acids Res. 22(2):4673–4680

Traunecker et al., (1988), Nature. 331:84–86.

Tur-Kaspa et al., (1986) Mol. Cell. Biol. 6:716–718.

Tutt et al., (1991), J. Immunol. 147:60–69.

Ugur and Jones (2000) *Mol Cell Biol* 11: 1432–32

Urdea (1988) Nucleic Acids Research. 11:4937–4957.

Urdea et al., (1991) Nucleic Acids Symp. Ser. 24:197–200.

Vaitukaitis et al., (1971) J. Clin. Endocrinol. Metab. 33:988–991

Valadon et al., (1996), J. Mol. Biol., 261:11–22.

Van der Lugt et al., (1991) Gene. 105:263–267.

Vil et al., (1992) Proc Natl Acad Sci US 89:11337–11341.

Vlasak et al., (1983) Eur. J. Biochem. 135:123–126.

Wabiko et al., (1986) DNA.5(4):305–314.

Wagner et al., (1996) Nat Biotechnol. 14(7):840–4.

Walker et al., (1996) Clin. Chem. 42:9–13.

Wang et al., (1997), Chromatographia, 44: 205–208.

Ward and Moss, (2000) *J. Virol.* 74:3771–80

Warrington et al., (1991) Genomics 11:701–708

Watson and Pessin, (2000) *J Biol Chem* 275:1261–8

Westerink, (1995), Proc. Natl. Acad. Sci USA., 92:4021–4025

White (1997) B.A. Ed. in Methods in Molecular Biology 67: Humana Press, Totowa

White et al. (1997) Genomics. 12:301–306.

Wilson et al., (1984) Cell. 37(3):767–78.

Wong et al., (1980) Gene. 10:87–94.

Wood et al., (1985) Proc. Natl. Acad. Sci. USA 82(6):1585–1588

Wood et al., (1993), Proc. Natl. Acad. Sci. USA, 90:4582–4585.

Wu and Ataai, (2000) Curr Opin Biotechnol. 11(2):205–8.

Wu and Wu, (1987) J. Biol. Chem. 262:4429–4432.

Wu and Wu, (1988) Biochemistry. 27:887–892.

Yagi T. et al., (1990) Proc. Natl. Acad. Sci. U.S.A. 87:9918–9922.

Yona et al., (1999) Proteins. 37(3):360–78

Yoon et al, (1998), J. Immunol. 160(7):3170–3179.

Zhan et al., (1998) *Cancer Immunol Immunother* 46:55–60

Zheng, X. X. et al. (1995), J. Immunol. 154:5590–5600.

Zhu et al., (1998), Cancer Res. 58(15):3209–3214.

Zou et al., (1994) Curr. Biol. 4:1099–1103.

Throughout this application, various publications, patents and published patent applications are cited. The disclosures of these publications, patents and published patent specification referenced in this application are hereby incorporated by reference into the present disclosure to more fully describe the state of the art to which this invention pertains.

TABLE I

| Seq Id No | Internal designation | Type | Vector |
|---|---|---|---|
| 1 | 119-003-4-0-C2-CS | DNA | pBluescriptII SK- |
| 2 | 105-016-1-0-D3-CS | DNA | pBluescriptII SK- |
| 3 | 105-016-3-0-G10-CS | DNA | pBluescriptII SK- |
| 4 | 105-026-1-0-A5-CS | DNA | pBluescriptII SK- |
| 5 | 105-031-1-0-A11-CS | DNA | pBluescriptII SK- |
| 6 | 105-031-2-0-D3-CS | DNA | pBluescriptII SK- |
| 7 | 105-035-2-0-C6-CS | DNA | pBluescriptII SK- |
| 8 | 105-037-2-0-H11-CS | DNA | pBluescriptII SK- |
| 9 | 105-053-4-0-E8-CS | DNA | pBluescriptII SK- |
| 10 | 105-074-3-0-H10-CS | DNA | pBluescriptII SK- |
| 11 | 105-089-3-0-G10-CS | DNA | pBluescriptII SK- |
| 12 | 105-095-2-0-G11-CS | DNA | pBluescriptII SK- |
| 13 | 106-006-1-0-E3-CS | DNA | pBluescriptII SK- |
| 14 | 106-037-1-0-E9-CS.cor | DNA | pBluescriptII SK- |
| 15 | 106-037-1-0-E9-CS.fr | DNA | pBluescriptII SK- |
| 16 | 106-043-4-0-H3-CS | DNA | pBluescriptII SK- |
| 17 | 110-007-1-0-C7-CS | DNA | pBluescriptII SK- |
| 18 | 114-016-1-0-H8-CS | DNA | pBluescriptII SK- |
| 19 | 116-004-3-0-A6-CS | DNA | pBluescriptII SK- |
| 20 | 116-054-3-0-E6-CS | DNA | pBluescriptII SK- |
| 21 | 116-055-1-0-A3-CS | DNA | pBluescriptII SK- |

TABLE I-continued

| Seq Id No | Internal designation | Type | Vector |
|---|---|---|---|
| 22 | 116-055-2-0-F7-CS | DNA | pBluescriptII SK- |
| 23 | 116-088-4-0-A9-CS | DNA | pBluescriptII SK- |
| 24 | 116-091-1-0-D9-CS | DNA | pBluescriptII SK- |
| 25 | 116-110-2-0-F4-CS | DNA | pBluescriptII SK- |
| 26 | 116-111-1-0-H9-CS | DNA | pBluescriptII SK- |
| 27 | 116-111-4-0-B3-CS | DNA | pBluescriptII SK- |
| 28 | 116-115-2-0-F8-CS | DNA | pBluescriptII SK- |
| 29 | 116-119-3-0-H5-CS | DNA | pBluescriptII SK- |
| 30 | 117-001-5-0-G3-CS | DNA | pBluescriptII SK- |
| 31 | 145-25-3-0-B4-CS.cor | DNA | pBluescriptII SK- |
| 32 | 145-25-3-0-B4-CS.fr | DNA | pBluescriptII SK- |
| 33 | 145-56-3-0-D5-CS | DNA | pBluescriptII SK- |
| 34 | 145-59-2-0-A7-CS | DNA | pBluescriptII SK- |
| 35 | 157-15-4-0-B11-CS | DNA | pBluescriptII SK- |
| 36 | 160-103-1-0-F11-CS | DNA | pBluescriptII SK- |
| 37 | 160-37-2-0-H7-CS | DNA | pBluescriptII SK- |
| 38 | 160-58-3-0-H3-CS | DNA | pBluescriptII SK- |
| 39 | 160-75-4-0-A9-CS | DNA | pBluescriptII SK- |
| 40 | 174-10-2-0-F8-CS | DNA | pPT |
| 41 | 174-33-3-0-F6-CS | DNA | pPT |
| 42 | 174-38-1-0-B6-CS | DNA | pPT |
| 43 | 174-38-3-0-C9-CS | DNA | pPT |
| 44 | 174-39-2-0-A3-CS | DNA | pPT |
| 45 | 174-41-1-0-A6-CS | DNA | pPT |
| 46 | 174-5-3-0-H7-CS | DNA | pPT |
| 47 | 174-7-4-0-H1-CS | DNA | pPT |
| 48 | 175-1-3-0-E5-CS.cor | DNA | pPT |
| 49 | 175-1-3-0-E5-CS.fr | DNA | pPT |
| 50 | 180-19-4-0-F4-CS | DNA | pBluescriptII SK- |
| 51 | 181-10-1-0-D10-CS | DNA | pBluescriptII SK- |
| 52 | 181-16-1-0-G7-CS | DNA | pBluescriptII SK- |
| 53 | 181-16-2-0-A7-CS | DNA | pBluescriptII SK- |
| 54 | 181-20-3-0-B5-CS | DNA | pBluescriptII SK- |
| 55 | 181-3-3-0-B8-CS | DNA | pBluescriptII SK- |
| 56 | 181-3-3-0-C9-CS | DNA | pBluescriptII SK- |
| 57 | 182-1-2-0-D12-CS | DNA | pBluescriptII SK- |
| 58 | 184-1-4-0-C11-CS | DNA | pBluescriptII SK- |
| 59 | 184-4-1-0-A11-CS | DNA | pBluescriptII SK- |
| 60 | 187-12-4-0-A8-CS | DNA | pBluescriptII SK- |
| 61 | 187-2-2-0-A3-CS | DNA | pBluescriptII SK- |
| 62 | 187-31-0-0-f12-CS | DNA | pBluescriptII SK- |
| 63 | 187-34-0-0-l12-CS | DNA | pBluescriptII SK- |
| 64 | 187-37-0-0-c10-CS | DNA | pBluescriptII SK- |
| 65 | 187-38-0-0-l10-CS | DNA | pBluescriptII SK- |
| 66 | 187-39-0-0-k12-CS | DNA | pBluescriptII SK- |
| 67 | 187-41-0-0-i21-CS | DNA | pBluescriptII SK- |
| 68 | 188-11-1-0-B3-CS | DNA | pBluescriptII SK- |
| 69 | 188-18-4-0-A9-CS | DNA | pBluescriptII SK- |
| 70 | 188-28-4-0-B12-CS.cor | DNA | pBluescriptII SK- |
| 71 | 188-28-4-0-B12-CS.fr | DNA | pBluescriptII SK- |
| 72 | 188-28-4-0-D4-CS | DNA | pBluescriptII SK- |
| 73 | 188-41-1-0-B8-CS.cor | DNA | pBluescriptII SK- |
| 74 | 188-41-1-0-B8-CS.fr | DNA | pBluescriptII SK- |
| 75 | 188-45-1-0-D9-CS | DNA | pBluescriptII SK- |
| 76 | 188-9-2-0-E1-CS | DNA | pBluescriptII SK- |
| 77 | 105-079-3-0-A11-CS | DNA | pBluescriptII SK- |
| 78 | 105-092-1-0-H7-CS | DNA | pBluescriptII SK- |
| 79 | 105-141-4-0-H9-CS | DNA | pBluescriptII SK- |
| 80 | 109-013-1-0-B9-CS | DNA | pBluescriptII SK- |
| 81 | 110-008-4-0-D9-CS | DNA | pBluescriptII SK- |
| 82 | 114-001-3-0-A2-CS | DNA | pBluescriptII SK- |
| 83 | 114-028-2-0-C1-CS | DNA | pBluescriptII SK- |
| 84 | 114-032-1-0-H10-CS | DNA | pBluescriptII SK- |
| 85 | 114-043-2-0-A10-CS | DNA | pBluescriptII SK- |
| 86 | 114-044-1-0-C5-CS | DNA | pBluescriptII SK- |
| 87 | 116-003-3-0-D10-CS | DNA | pBluescriptII SK- |
| 88 | 116-003-3-0-G12-CS | DNA | pBluescriptII SK- |
| 89 | 116-011-2-0-F11-CS | DNA | pBluescriptII SK- |
| 90 | 116-033-3-0-E4-CS | DNA | pBluescriptII SK- |
| 91 | 116-041-4-0-B6-CS | DNA | pBluescriptII SK- |
| 92 | 116-044-2-0-C4-CS | DNA | pBluescriptII SK- |
| 93 | 116-075-1-0-E6-CS | DNA | pBluescriptII SK- |
| 94 | 116-094-4-0-G5-CS | DNA | pBluescriptII SK- |
| 95 | 117-005-3-0-F2-CS | DNA | pBluescriptII SK- |
| 96 | 121-007-3-0-D9-CS | DNA | pBluescriptII SK- |
| 97 | 145-91-3-0-D10-CS | DNA | pBluescriptII SK- |
| 98 | 157-17-1-0-F4-CS | DNA | pBluescriptII SK- |
| 99 | 160-11-3-0-G8-CS | DNA | pBluescriptII SK- |
| 100 | 160-24-1-0-F12-CS | DNA | pBluescriptII SK- |
| 101 | 160-24-2-0-E9-CS | DNA | pBluescriptII SK- |
| 102 | 160-25-4-0-D2-CS | DNA | pBluescriptII SK- |
| 103 | 160-31-3-0-A11-CS | DNA | pBluescriptII SK- |
| 104 | 160-32-1-0-F6-CS | DNA | pBluescriptII SK- |
| 105 | 160-37-1-0-A3-CS | DNA | pBluescriptII SK- |
| 106 | 160-40-3-0-E9-CS | DNA | pBluescriptII SK- |
| 107 | 160-58-3-0-E4-CS | DNA | pBluescriptII SK- |
| 108 | 160-85-3-0-D4-CS | DNA | pBluescriptII SK- |
| 109 | 160-95-3-0-A11-CS | DNA | pBluescriptII SK- |
| 110 | 162-10-4-0-F9-CS.cor | DNA | pBluescriptII SK- |
| 111 | 162-10-4-0-F9-CS.fr | DNA | pBluescriptII SK- |
| 112 | 174-13-2-0-E4-CS | DNA | pPT |
| 113 | 174-46-2-0-B11-CS | DNA | pPT |
| 114 | 179-8-2-0-A6-CS | DNA | pBluescriptII SK- |
| 115 | 180-22-3-0-B6-CS | DNA | pBluescriptII SK- |
| 116 | 181-13-1-0-F7-CS | DNA | pBluescriptII SK- |
| 117 | 181-15-4-0-F7-CS | DNA | pBluescriptII SK- |
| 118 | 181-20-1-0-G7-CS | DNA | pBluescriptII SK- |
| 119 | 184-15-3-0-D1-CS | DNA | pBluescriptII SK- |
| 120 | 187-12-2-0-G11-CS | DNA | pBluescriptII SK- |
| 121 | 187-2-2-0-A12-CS | DNA | pBluescriptII SK- |
| 122 | 187-30-0-0-k23-CS | DNA | pBluescriptII SK- |
| 123 | 187-36-0-0-e19-CS | DNA | pBluescriptII SK- |
| 124 | 187-38-0-0-d22-CS | DNA | pBluescriptII SK- |
| 125 | 187-39-0-0-b9-CS | DNA | pBluescriptII SK- |
| 126 | 187-39-0-0-g6-CS | DNA | pBluescriptII SK- |
| 127 | 187-45-0-0-l18-CS | DNA | pBluescriptII SK- |
| 128 | 187-45-0-0-m21-CS | DNA | PBluescriptII SK- |
| 129 | 187-45-0-0-n8-CS | DNA | pBluescriptII SK- |
| 130 | 187-46-0-0-f23-CS | DNA | pBluescriptII SK- |
| 131 | 187-5-1-0-A12-CS | DNA | pBluescriptII SK- |
| 132 | 187-5-1-0-F6-CS | DNA | pBluescriptII SK- |
| 133 | 187-5-2-0-B2-CS | DNA | pBluescriptII SK- |
| 134 | 187-5-3-0-D5-CS | DNA | pBluescriptII SK- |
| 135 | 187-51-0-0-f9-CS | DNA | pBluescriptII SK- |
| 136 | 187-6-1-0-B9-CS | DNA | pBluescriptII SK- |
| 137 | 187-6-4-0-C10-CS | DNA | PBluescriptII SK- |
| 138 | 188-19-2-0-C8-CS | DNA | pBluescriptII SK- |
| 139 | 188-22-4-0-G6-CS | DNA | pBluescriptII SK- |
| 140 | 188-28-4-0-D11-CS | DNA | pBluescriptII SK- |
| 141 | 188-29-1-0-E10-CS | DNA | pBluescriptII SK- |
| 142 | 188-34-4-0-ES-CS | DNA | pBluescriptII SK- |
| 143 | 188-9-3-0-A5-CS | DNA | pBluescriptII SK- |
| 144 | 105-021-3-0-C3-CS | DNA | pBluescriptII SK- |
| 145 | 105-037-4-0-H12-CS | DNA | pBluescriptII SK- |
| 146 | 105-073-2-0-A7-CS | DNA | pBluescriptII SK- |
| 147 | 109-002-4-0-C6-CS | DNA | pBluescriptII SK- |
| 148 | 109-003-1-0-G4-CS | DNA | pBluescriptII SK- |
| 149 | 116-118-4-0-A8-CS | DNA | pBluescriptII SK- |
| 150 | 145-52-2-0-D12-CS | DNA | pBluescriptII SK- |
| 151 | 145-7-2-0-G5-CS | DNA | pBluescriptII SK- |
| 152 | 145-7-3-0-D3-CS | DNA | pBluescriptII SK- |
| 153 | 157-17-2-0-C1-CS | DNA | pBluescriptII SK- |
| 154 | 160-101-3-0-H2-CS | DNA | pBluescriptII SK- |
| 155 | 160-12-1-0-D10-CS | DNA | pBluescriptII SK- |
| 156 | 160-28-4-0-C4-CS | DNA | pBluescriptII SK- |
| 157 | 160-31-3-0-E4-CS | DNA | pBluescriptII SK- |
| 158 | 160-40-1-0-H4-CS | DNA | pBluescriptII SK- |
| 159 | 160-54-1-0-F7-CS | DNA | pBluescriptII SK- |
| 160 | 160-88-3-0-A8-CS.cor | DNA | pBluescriptII SK- |
| 161 | 160-88-3-0-A8-CS.fr | DNA | pBluescriptII SK- |
| 162 | 160-99-4-0-E4-CS | DNA | pBluescriptII SK- |
| 163 | 161-5-4-0-B6-CS | DNA | pBluescriptII SK- |
| 164 | 174-17-1-0-D6-CS | DNA | pPT |
| 165 | 174-32-4-0-F8-CS | DNA | pPT |
| 166 | 174-38-4-0-D11-CS | DNA | pPT |
| 167 | 174-8-2-0-C10-CS | DNA | pPT |
| 168 | 179-14-2-0-F11-CS | DNA | pBluescriptII SK- |
| 169 | 179-9-4-0-B8-CS | DNA | pBluescriptII SK- |
| 170 | 181-10-1-0-C9-CS | DNA | pBluescriptII SK- |
| 171 | 187-5-3-0-C7-CS | DNA | pBluescriptII SK- |
| 172 | 188-26-4-0-F5-CS | DNA | pBluescriptII SK- |
| 173 | 188-27-3-0-G1-CS | DNA | pBluescriptII SK- |
| 174 | 188-29-2-0-H1-CS | DNA | pBluescriptII SK- |
| 175 | 188-31-1-0-E6-CS | DNA | pBluescriptII SK- |

TABLE I-continued

| Seq Id No | Internal designation | Type | Vector |
|---|---|---|---|
| 176 | 188-45-1-0-D3-CS | DNA | pBluescriptII SK- |
| 177 | 188-5-1-0-H6-CS | DNA | pBluescriptII SK- |
| 178 | 188-9-1-0-C10-CS | DNA | pBluescriptII SK- |
| 179 | 105-016-3-0-C5-CS | DNA | pBluescriptII SK- |
| 180 | 105-026-4-0-D9-CS | DNA | pBluescriptII SK- |
| 181 | 105-053-2-0-D9-CS | DNA | pBluescriptII SK- |
| 182 | 105-069-3-0-A11-CS | DNA | pBluescriptII SK- |
| 183 | 105-076-4-0-F6-CS | DNA | PBluescriptII SK- |
| 184 | 105-135-2-0-F9-CS | DNA | pBluescriptII SK- |
| 185 | 106-023-4-0-F6-CS | DNA | pBluescriptII SK- |
| 186 | 110-001-3-0-C11-CS | DNA | pBluescriptII SK- |
| 187 | 110-002-3-0-F9-CS | DNA | pBluescriptII SK- |
| 188 | 114-019-3-0-D9-CS | DNA | pBluescriptII SK- |
| 189 | 114-029-1-0-C6-CS | DNA | pBluescriptII SK- |
| 190 | 114-032-4-0-B1-CS | DNA | pBluescriptII SK- |
| 191 | 114-070-2-0-H4-CS | DNA | pBluescriptII SK- |
| 192 | 116-016-3-0-F11-CS | DNA | pBluescriptII SK- |
| 193 | 116-022-4-0-G2-CS | DNA | pBluescriptII SK- |
| 194 | 116-052-2-0-H8-CS | DNA | pBluescriptII SK- |
| 195 | 116-053-4-0-B4-CS | DNA | pBluescriptII SK- |
| 196 | 116-094-3-0-H2-CS | DNA | pBluescriptII SK- |
| 197 | 116-112-4-0-C7-CS | DNA | pBluescriptII SK- |
| 198 | 116-123-3-0-F12-CS | DNA | pBluescriptII SK- |
| 199 | 123-008-1-0-C5-CS | DNA | pBluescriptII SK- |
| 200 | 145-53-2-0-H8-CS | DNA | pBluescriptII SK- |
| 201 | 145-57-2-0-C9-CS.cor | DNA | pBluescriptII SK- |
| 202 | 145-57-2-0-C9-CS.fr | DNA | pBluescriptII SK- |
| 203 | 145-7-3-0-B12-CS | DNA | pBluescriptII SK- |
| 204 | 157-12-2-0-D1-CS | DNA | pBluescriptII SK- |
| 205 | 157-16-2-0-D5-CS | DNA | PBluescriptII SK- |
| 206 | 157-18-2-0-A7-CS | DNA | pBluescriptII SK- |
| 207 | 160-103-1-0-B10-CS | DNA | pBluescriptII SK- |
| 208 | 160-104-4-0-F3-CS | DNA | pBluescriptII SK- |
| 209 | 160-22-2-0-D10-CS | DNA | pBluescriptII SK- |
| 210 | 160-24-3-0-F12-CS | DNA | pBluescriptII SK- |
| 211 | 160-3-2-0-H3-CS | DNA | pBluescriptII SK- |
| 212 | 160-58-2-0-A2-CS | DNA | pBluescriptII SK- |
| 213 | 160-73-1-0-B4-CS | DNA | pBluescriptII SK- |
| 214 | 160-75-4-0-E6-CS | DNA | pBluescriptII SK- |
| 215 | 160-97-3-0-E9-CS | DNA | pBluescriptII SK- |
| 216 | 174-1-4-0-E9-CS | DNA | pPT |
| 217 | 174-12-4-0-C2-CS | DNA | pPT |
| 218 | 180-19-4-0-H2-CS | DNA | pBluescriptII SK- |
| 219 | 181-10-4-0-G12-CS | DNA | pBluescriptII SK- |
| 220 | 181-3-2-0-F6-CS | DNA | pBluescriptII SK- |
| 221 | 181-4-4-0-A12-CS | DNA | pBluescriptII SK- |
| 222 | 181-9-2-0-F12-CS.cor | DNA | pBluescriptII SK- |
| 223 | 181-9-2-0-F12-CS.fr | DNA | pBluescriptII SK- |
| 224 | 184-13-3-0-E11-CS | DNA | pBluescriptII SK- |
| 225 | 184-4-2-0-D3-CS | DNA | pBluescriptII SK- |
| 226 | 184-7-1-0-E7-CS | DNA | PBluescriptII SK- |
| 227 | 184-8-4-0-G9-CS | DNA | pBluescriptII SK- |
| 228 | 187-10-3-0-G9-CS | DNA | pBluescriptII SK- |
| 229 | 187-32-0-0-m20-CS | DNA | pBluescriptII SK- |
| 230 | 187-32-0-0-n21-CS.cor | DNA | pBluescriptII SK- |
| 231 | 187-32-0-0-n21-CS.fr | DNA | pBluescriptII SK- |
| 232 | 187-4-2-0-E6-CS | DNA | pBluescriptII SK- |
| 233 | 187-40-0-0-i15-CS | DNA | pBluescriptII SK- |
| 234 | 187-47-0-0-g24-CS | DNA | pBluescriptII SK- |
| 235 | 187-9-3-0-A2-CS | DNA | pBluescriptII SK- |
| 236 | 188-26-4-0-H1-CS | DNA | pBluescriptII SK- |
| 237 | 188-35-3-0-G9-CS | DNA | pBluescriptII SK- |
| 238 | 188-38-4-0-D8-CS | DNA | pBluescriptII SK- |
| 239 | 188-41-1-0-E6-CS | DNA | pBluescriptII SK- |
| 240 | 188-42-2-0-F3-CS.cor | DNA | pBluescriptII SK- |
| 241 | 188-42-2-0-F3-CS.fr | DNA | pBluescriptII SK- |
| 242 | 119-003-4-0-C2-CS | PRT | pBluescriptII SK- |
| 243 | 105-016-1-0-D3-CS | PRT | pBluescriptII SK- |
| 244 | 105-016-3-0-G10-CS | PRT | pBluescriptII SK- |
| 245 | 105-026-1-0-A5-CS | PRT | pBluescriptII SK- |
| 246 | 105-031-1-0-A11-CS | PRT | pBluescriptII SK- |
| 247 | 105-031-2-0-D3-CS | PRT | pBluescriptII SK- |
| 248 | 105-035-2-0-C6-CS | PRT | pBluescriptII SK- |
| 249 | 105-037-2-0-H11-CS | PRT | pBluescriptII SK- |
| 250 | 105-053-4-0-E8-CS | PRT | pBluescriptII SK- |
| 251 | 105-074-3-0-H10-CS | PRT | pBluescriptII SK- |
| 252 | 105-089-3-0-G10-CS | PRT | pBluescriptII SK- |
| 253 | 105-095-2-0-G11-CS | PRT | pBluescriptII SK- |
| 254 | 106-006-1-0-E3-CS | PRT | pBluescriptII SK- |
| 255 | 106-037-1-0-E9-CS.cor | PRT | pBluescriptII SK- |
| 256 | 106-037-1-0-E9-CS.fr | PRT | pBluescriptII SK- |
| 257 | 106-043-4-0-H3-CS | PRT | pBluescriptII SK- |
| 258 | 110-007-1-0-C7-CS | PRT | pBluescriptII SK- |
| 259 | 114-016-1-0-H8-CS | PRT | pBluescriptII SK- |
| 260 | 116-004-3-0-A6-CS | PRT | pBluescriptII SK- |
| 261 | 116-054-3-0-E6-CS | PRT | pBluescriptII SK- |
| 262 | 116-055-1-0-A3-CS | PRT | pBluescriptII SK- |
| 263 | 116-055-2-0-F7-CS | PRT | pBluescriptII SK- |
| 264 | 116-088-4-0-A9-CS | PRT | pBluescriptII SK- |
| 265 | 116-091-1-0-D9-CS | PRT | pBluescriptII SK- |
| 266 | 116-110-2-0-F4-CS | PRT | pBluescriptII SK- |
| 267 | 116-111-1-0-H9-CS | PRT | pBluescriptII SK- |
| 268 | 116-111-4-0-B3-CS | PRT | pBluescriptII SK- |
| 269 | 116-115-2-0-F8-CS | PRT | pBluescriptII SK- |
| 270 | 116-119-3-0-H5-CS | PRT | pBluescriptII SK- |
| 271 | 117-001-5-0-G3-CS | PRT | pBluescriptII SK- |
| 272 | 145-25-3-0-B4-CS.cor | PRT | pBluescriptII SK- |
| 273 | 145-25-3-0-B4-CS.fr | PRT | pBluescriptII SK- |
| 274 | 145-56-3-0-D5-CS | PRT | pBluescriptII SK- |
| 275 | 145-59-2-0-A7-CS | PRT | pBluescriptII SK- |
| 276 | 157-15-4-0-B11-CS | PRT | pBluescriptII SK- |
| 277 | 160-103-1-0-F11-CS | PRT | pBluescriptII SK- |
| 278 | 160-37-2-0-H7-CS | PRT | pBluescriptII SK- |
| 279 | 160-58-3-0-H3-CS | PRT | pBluescriptII SK- |
| 280 | 160-75-4-0-A9-CS | PRT | pBluescriptII SK- |
| 281 | 174-10-2-0-F8-CS | PRT | pPT |
| 282 | 174-33-3-0-F6-CS | PRT | pPT |
| 283 | 174-38-1-0-B6-CS | PRT | pPT |
| 284 | 174-38-3-0-C9-CS | PRT | pPT |
| 285 | 174-39-2-0-A3-CS | PRT | pPT |
| 286 | 174-41-1-0-A6-CS | PRT | pPT |
| 287 | 174-5-3-0-H7-CS | PRT | pPT |
| 288 | 174-7-4-0-H1-CS | PRT | pPT |
| 289 | 175-1-3-0-E5-CS.cor | PRT | pPT |
| 290 | 175-1-3-0-E5-CS.fr | PRT | pPT |
| 291 | 180-19-4-0-F4-CS | PRT | pBluescriptII SK- |
| 292 | 181-10-1-0-D10-CS | PRT | pBluescriptII SK- |
| 293 | 181-16-1-0-G7-CS | PRT | pBluescriptII SK- |
| 294 | 181-16-2-0-A7-CS | PRT | pBluescriptII SK- |
| 295 | 181-20-3-0-B5-CS | PRT | pBluescriptII SK- |
| 296 | 181-3-3-0-B8-CS | PRT | pBluescriptII SK- |
| 297 | 181-3-3-0-C9-CS | PRT | pBluescriptII SK- |
| 298 | 182-1-2-0-D12-CS | PRT | pBluescriptII SK- |
| 299 | 184-1-4-0-C11-CS | PRT | pBluescriptII SK- |
| 300 | 184-4-1-0-A11-CS | PRT | pBluescriptII SK- |
| 301 | 187-12-4-0-A8-CS | PRT | pBluescriptII SK- |
| 302 | 187-2-2-0-A3-CS | PRT | pBluescriptII SK- |
| 303 | 187-31-0-0-f12-CS | PRT | pBluescriptII SK- |
| 304 | 187-34-0-0-l12-CS | PRT | pBluescriptII SK- |
| 305 | 187-37-0-0-c10-CS | PRT | pBluescriptII SK- |
| 306 | 187-38-0-0-l10-CS | PRT | pBluescriptII SK- |
| 307 | 187-39-0-0-k12-CS | PRT | pBluescriptII SK- |
| 308 | 187-41-0-0-i21-CS | PRT | pBluescriptII SK- |
| 309 | 188-11-1-0-B3-CS | PRT | pBluescriptII SK- |
| 310 | 188-18-4-0-A9-CS | PRT | pBluescriptII SK- |
| 311 | 188-28-4-0-B12-CS.cor | PRT | pBluescriptII SK- |
| 312 | 188-28-4-0-B12-CS.fr | PRT | pBluescriptII SK- |
| 313 | 188-28-4-0-D4-CS | PRT | pBluescriptII SK- |
| 314 | 188-41-1-0-B8-CS.cor | PRT | pBluescriptII SK- |
| 315 | 188-41-1-0-B8-CS.fr | PRT | pBluescriptII SK- |
| 316 | 188-45-1-0-D9-CS | PRT | pBluescriptII SK- |
| 317 | 188-9-2-0-E1-CS | PRT | pBluescriptII SK- |
| 318 | 105-079-3-0-A11-CS | PRT | pBluescriptII SK- |
| 319 | 105-092-1-0-H7-CS | PRT | pBluescriptII SK- |
| 320 | 105-141-4-0-H9-CS | PRT | pBluescriptII SK- |
| 321 | 109-013-1-0-B9-CS | PRT | pBluescriptII SK- |
| 322 | 110-008-4-0-D9-CS | PRT | pBluescriptII SK- |
| 323 | 114-001-3-0-A2-CS | PRT | pBluescriptII SK- |
| 324 | 114-028-2-0-C1-CS | PRT | pBluescriptII SK- |
| 325 | 114-032-1-0-H10-CS | PRT | pBluescriptII SK- |
| 326 | 114-043-2-0-A10-CS | PRT | pBluescriptII SK- |
| 327 | 114-044-1-0-C5-CS | PRT | pBluescriptII SK- |
| 328 | 116-003-3-0-D10-CS | PRT | pBluescriptII SK- |
| 329 | 116-003-3-0-G12-CS | PRT | pBluescriptII SK- |

TABLE I-continued

| Seq Id No | Internal designation | Type | Vector |
|---|---|---|---|
| 330 | 116-011-2-0-F11-CS | PRT | pBluescriptII SK- |
| 331 | 116-033-3-0-E4-CS | PRT | pBluescriptII SK- |
| 332 | 116-041-4-0-B6-CS | PRT | pBluescriptII SK- |
| 333 | 116-044-2-0-C4-CS | PRT | pBluescriptII SK- |
| 334 | 116-075-1-0-E6-CS | PRT | pBluescriptII SK- |
| 335 | 116-094-4-0-G5-CS | PRT | pBluescriptII SK- |
| 336 | 117-005-3-0-F2-CS | PRT | pBluescriptII SK- |
| 337 | 121-007-3-0-D9-CS | PRT | pBluescriptII SK- |
| 338 | 145-91-3-0-D10-CS | PRT | pBluescriptII SK- |
| 339 | 157-17-1-0-F4-CS | PRT | pBluescriptII SK- |
| 340 | 160-11-3-0-G8-CS | PRT | pBluescriptII SK- |
| 341 | 160-24-1-0-F12-CS | PRT | pBluescriptII SK- |
| 342 | 160-24-2-0-E9-CS | PRT | pBluescriptII SK- |
| 343 | 160-25-4-0-D2-CS | PRT | pBluescriptII SK- |
| 344 | 160-31-3-0-A11-CS | PRT | pBluescriptII SK- |
| 345 | 160-32-1-0-F6-CS | PRT | pBluescriptII SK- |
| 346 | 160-37-1-0-A3-CS | PRT | pBluescriptII SK- |
| 347 | 160-40-3-0-E9-CS | PRT | pBluescriptII SK- |
| 348 | 160-58-3-0-E4-CS | PRT | pBluescriptII SK- |
| 349 | 160-85-3-0-D4-CS | PRT | pBluescriptII SK- |
| 350 | 160-95-3-0-A11-CS | PRT | pBluescriptII SK- |
| 351 | 162-10-4-0-F9-CS.cor | PRT | pBluescriptII SK- |
| 352 | 162-10-4-0-F9-CS.fr | PRT | pBluescriptII SK- |
| 353 | 174-13-2-0-E4-CS | PRT | pPT |
| 354 | 174-46-2-0-B11-CS | PRT | pPT |
| 355 | 179-8-2-0-A6-CS | PRT | pBluescriptII SK- |
| 356 | 180-22-3-0-B6-CS | PRT | pBluescriptII SK- |
| 357 | 181-13-1-0-F7-CS | PRT | pBluescriptII SK- |
| 358 | 181-15-4-0-F7-CS | PRT | pBluescriptII SK- |
| 359 | 181-20-1-0-G7-CS | PRT | pBluescriptII SK- |
| 360 | 184-15-3-0-D1-CS | PRT | pBluescriptII SK- |
| 361 | 187-12-2-0-G11-CS | PRT | pBluescriptII SK- |
| 362 | 187-2-2-0-A12-CS | PRT | pBluescriptII SK- |
| 363 | 187-30-0-0-k23-CS | PRT | pBluescriptII SK- |
| 364 | 187-36-0-0-e19-CS | PRT | pBluescriptII SK- |
| 365 | 187-38-0-0-d22-CS | PRT | pBluescriptII SK- |
| 366 | 187-39-0-0-b9-CS | PRT | pBluescriptII SK- |
| 367 | 187-39-0-0-g6-CS | PRT | pBluescriptII SK- |
| 368 | 187-45-0-0-l18-CS | PRT | pBluescriptII SK- |
| 369 | 187-45-0-0-m21-CS | PRT | pBluescriptII SK- |
| 370 | 187-45-0-0-n8-CS | PRT | pBluescriptII SK- |
| 371 | 187-46-0-0-f23-CS | PRT | pBluescriptII SK- |
| 372 | 187-5-1-0-A12-CS | PRT | pBluescriptII SK- |
| 373 | 187-5-1-0-F6-CS | PRT | pBluescriptII SK- |
| 374 | 187-5-2-0-B2-CS | PRT | pBluescriptII SK- |
| 375 | 187-5-3-0-D5-CS | PRT | pBluescriptII SK- |
| 376 | 187-51-0-0-f9-CS | PRT | pBluescriptII SK- |
| 377 | 187-6-1-0-B9-CS | PRT | pBluescriptII SK- |
| 378 | 187-6-4-0-C10-CS | PRT | pBluescriptII SK- |
| 379 | 188-19-2-0-C8-CS | PRT | pBluescriptII SK- |
| 380 | 188-22-4-0-G6-CS | PRT | pBluescriptII SK- |
| 381 | 188-28-4-0-D11-CS | PRT | pBluescriptII SK- |
| 382 | 188-29-1-0-E10-CS | PRT | pBluescriptII SK- |
| 383 | 188-34-4-0-ES-CS | PRT | pBluescriptII SK- |
| 384 | 188-9-3-0-A5-CS | PRT | pBluescriptII SK- |
| 385 | 105-021-3-0-C3-CS | PRT | pBluescriptII SK- |
| 386 | 105-037-4-0-H12-CS | PRT | pBluescriptII SK- |
| 387 | 105-073-2-0-A7-CS | PRT | pBluescriptII SK- |
| 388 | 109-002-4-0-C6-CS | PRT | pBluescriptII SK- |
| 389 | 109-003-1-0-G4-CS | PRT | pBluescriptII SK- |
| 390 | 116-118-4-0-A8-CS | PRT | pBluescriptII SK- |
| 391 | 145-52-2-0-D12-CS | PRT | pBluescriptII SK- |
| 392 | 145-7-2-0-G5-CS | PRT | pBluescriptII SK- |
| 393 | 145-7-3-0-D3-CS | PRT | pBluescriptII SK- |
| 394 | 157-17-2-0-C1-CS | PRT | pBluescriptII SK- |
| 395 | 160-101-3-0-H2-CS | PRT | pBluescriptII SK- |
| 396 | 160-12-1-0-D10-CS | PRT | pBluescriptII SK- |
| 397 | 160-28-4-0-C4-CS | PRT | pBluescriptII SK- |
| 398 | 160-31-3-0-E4-CS | PRT | pBluescriptII SK- |
| 399 | 160-40-1-0-H4-CS | PRT | pBluescriptII SK- |
| 400 | 160-54-1-0-F7-CS | PRT | pBluescriptII SK- |
| 401 | 160-88-3-0-A8-CS.cor | PRT | pBluescriptII SK- |
| 402 | 160-88-3-0-A8-CS.fr | PRT | pBluescriptII SK- |
| 403 | 160-99-4-0-E4-CS | PRT | pBluescriptII SK- |
| 404 | 161-5-4-0-B6-CS | PRT | pBluescriptII SK- |
| 405 | 174-17-1-0-D6-CS | PRT | pPT |
| 406 | 174-32-4-0-F8-CS | PRT | pPT |
| 407 | 174-38-4-0-D11-CS | PRT | pPT |
| 408 | 174-8-2-0-C10-CS | PRT | pPT |
| 409 | 179-14-2-0-F11-CS | PRT | pBluescriptII SK- |
| 410 | 179-9-4-0-B8-CS | PRT | pBluescriptII SK- |
| 411 | 181-10-1-0-C9-CS | PRT | pBluescriptII SK- |
| 412 | 187-5-3-0-C7-CS | PRT | PBluescriptII SK- |
| 413 | 188-26-4-0-F5-CS | PRT | pBluescriptII SK- |
| 414 | 188-27-3-0-G1-CS | PRT | pBluescriptII SK- |
| 415 | 188-29-2-0-H1-CS | PRT | pBluescriptII SK- |
| 416 | 188-31-1-0-E6-CS | PRT | pBluescriptII SK- |
| 417 | 188-45-1-0-D3-CS | PRT | pBluescriptII SK- |
| 418 | 188-5-1-0-H6-CS | PRT | pBluescriptII SK- |
| 419 | 188-9-1-0-C10-CS | PRT | pBluescriptII SK- |
| 420 | 105-016-3-0-C5-CS | PRT | pBluescriptII SK- |
| 421 | 105-026-4-0-D9-CS | PRT | pBluescriptII SK- |
| 422 | 105-053-2-0-D9-CS | PRT | pBluescriptII SK- |
| 423 | 105-069-3-0-A11-CS | PRT | pBluescriptII SK- |
| 424 | 105-076-4-0-F6-CS | PRT | pBluescriptII SK- |
| 425 | 105-135-2-0-F9-CS | PRT | pBluescriptII SK- |
| 426 | 106-023-4-0-F6-CS | PRT | pBluescriptII SK- |
| 427 | 110-001-3-0-C11-CS | PRT | pBluescriptII SK- |
| 428 | 110-002-3-0-F9-CS | PRT | pBluescriptII SK- |
| 429 | 114-019-3-0-D9-CS | PRT | pBluescriptII SK- |
| 430 | 114-029-1-0-C6-CS | PRT | pBluescriptII SK- |
| 431 | 114-032-4-0-B1-CS | PRT | pBluescriptII SK- |
| 432 | 114-070-2-0-H4-CS | PRT | pBluescriptII SK- |
| 433 | 116-016-3-0-F11-CS | PRT | pBluescriptII SK- |
| 434 | 116-022-4-0-G2-CS | PRT | pBluescriptII SK- |
| 435 | 116-052-2-0-H8-CS | PRT | pBluescriptII SK- |
| 436 | 116-053-4-0-B4-CS | PRT | pBluescriptII SK- |
| 437 | 116-094-3-0-H2-CS | PRT | pBluescriptII SK- |
| 438 | 116-112-4-0-C7-CS | PRT | pBluescriptII SK- |
| 439 | 116-123-3-0-F12-CS | PRT | pBluescriptII SK- |
| 440 | 123-008-1-0-C5-CS | PRT | pBluescriptII SK- |
| 441 | 145-53-2-0-H8-CS | PRT | pBluescriptII SK- |
| 442 | 145-57-2-0-C9-CS.cor | PRT | pBluescriptII SK- |
| 443 | 145-57-2-0-C9-CS.fr | PRT | pBluescriptII SK- |
| 444 | 145-7-3-0-B12-CS | PRT | pBluescriptII SK- |
| 445 | 157-12-2-0-D1-CS | PRT | pBluescriptII SK- |
| 446 | 157-16-2-0-D5-CS | PRT | pBluescriptII SK- |
| 447 | 157-18-2-0-A7-CS | PRT | pBluescriptII SK- |
| 448 | 160-103-1-0-B10-CS | PRT | pBluescriptII SK- |
| 449 | 160-104-4-0-F3-CS | PRT | pBluescriptII SK- |
| 450 | 160-22-2-0-D10-CS | PRT | pBluescriptII SK- |
| 451 | 160-24-3-0-F12-CS | PRT | pBluescriptII SK- |
| 452 | 160-3-2-0-H3-CS | PRT | pBluescriptII SK- |
| 453 | 160-58-2-0-A2-CS | PRT | pBluescriptII SK- |
| 454 | 160-73-1-0-B4-CS | PRT | pBluescriptII SK- |
| 455 | 160-75-4-0-E6-CS | PRT | pBluescriptII SK- |
| 456 | 160-97-3-0-E9-CS | PRT | pBluescriptII SK- |
| 457 | 174-1-4-0-E9-CS | PRT | pPT |
| 458 | 174-12-4-0-C2-CS | PRT | pPT |
| 459 | 180-19-4-0-H2-CS | PRT | pBluescriptII SK- |
| 460 | 181-10-4-0-G12-CS | PRT | pBluescriptII SK- |
| 461 | 181-3-2-0-F6-CS | PRT | pBluescriptII SK- |
| 462 | 181-4-4-0-A12-CS | PRT | pBluescriptII SK- |
| 463 | 181-9-2-0-F12-CS.cor | PRT | pBluescriptII SK- |
| 464 | 181-9-2-0-F12-CS.fr | PRT | pBluescriptII SK- |
| 465 | 184-13-3-0-E11-CS | PRT | pBluescriptII SK- |
| 466 | 184-4-2-0-D3-CS | PRT | pBluescriptII SK- |
| 467 | 184-7-1-0-E7-CS | PRT | pBluescriptII SK- |
| 468 | 184-8-4-0-G9-CS | PRT | pBluescriptII SK- |
| 469 | 187-10-3-0-G9-CS | PRT | pBluescriptII SK- |
| 470 | 187-32-0-0-m20-CS | PRT | pBluescriptII SK- |
| 471 | 187-32-0-0-n21-CS.cor | PRT | pBluescriptII SK- |
| 472 | 187-32-0-0-n21-CS.fr | PRT | pBluescriptII SK- |
| 473 | 187-4-2-0-E6-CS | PRT | pBluescriptII SK- |
| 474 | 187-40-0-0-i15-CS | PRT | pBluescriptII SK- |
| 475 | 187-47-0-0-g24-CS | PRT | pBluescriptII SK- |
| 476 | 187-9-3-0-A2-CS | PRT | pBluescriptII SK- |
| 477 | 188-26-4-0-H1-CS | PRT | pBluescriptII SK- |
| 478 | 188-35-3-0-G9-CS | PRT | pBluescriptII SK- |
| 479 | 188-38-4-0-D8-CS | PRT | pBluescriptII SK- |
| 480 | 188-41-1-0-E6-CS | PRT | pBluescriptII SK- |
| 481 | 188-42-2-0-F3-CS.cor | PRT | pBluescriptII SK- |
| 482 | 188-42-2-0-F3-CS.fr | PRT | pBluescriptII SK- |

TABLE II

| Seq Id No | Full coding sequence | Signal sequence | Coding sequence for mature protein | Polyadenylation signal | Polyadenylation site |
|---|---|---|---|---|---|
| 1 | [169–1692] | [169–249] | [250–1692] | [2126–2131] | [2152–2201] |
| 2 | [148–1140] | [148–240] | [241–1140] | [1592–1597] | [1615–1631] |
| 3 | [85–906] | [85–135] | [136–906] | [1159–1164] | [1184–1245] |
| 4 | [31–1248] | [31–135] | [136–1248] | None detected | [1607–1623] |
| 5 | [72–143] | [72–119] | [120–143] | [1416–1421] | [1438–1454] |
| 6 | [111–1154] | [111–197] | [198–1154] | [1602–1607] | [1623–1639] |
| 7 | [66–1256] | [66–173] | [174–1256] | None detected | [1752–1768] |
| 8 | [190–1398] | [190–252] | [253–1398] | [1470–1475] | [1494–1510] |
| 9 | [78–410] | [78–155] | [156–410] | None detected | [866–882] |
| 10 | [84–299] | [84–134] | [135–299] | [1814–1819] | [1833–1849] |
| 11 | [55–468] | [55–99] | [100–468] | [531–536] | [549–565] |
| 12 | [152–475] | [152–244] | [245–475] | [1623–1628] | [1647–1663] |
| 13 | [112–552] | [112–183] | [184–552] | [706–711] | [729–744] |
| 14 | [101–1243] | [101–199] | [200–1243] | [1720–1725] | [1745–1759] |
| 15 | [101–517] | [101–199] | [200–517] | [1716–1721] | [1741–1755] |
| 16 | [59–853] | [59–100] | [101–853] | [894–899] | [922–936] |
| 17 | [73–672] | [73–132] | [133–672] | [689–694] | [711–747] |
| 18 | [94–1275] | [94–210] | [211–1275] | [1849–1854] | [1870–1884] |
| 19 | [42–515] | [42–92] | [93–515] | [649–654] | [677–691] |
| 20 | [271–969] | [271–366] | [367–969] | [1093–1098] | [1124–1138] |
| 21 | [76–276] | [76–135] | [136–276] | [436–441] | [455–468] |
| 22 | [6–287] | [6–80] | [81–287] | [684–689] | [706–720] |
| 23 | [171–692] | [171–227] | [228–692] | [691–696] | [713–727] |
| 24 | [137–454] | [137–187] | [188–454] | [440–445] | [456–470] |
| 25 | [238–609] | [238–291] | [292–609] | [948–953] | [973–987] |
| 26 | [80–862] | [80–127] | [128–862] | [875–880] | [894–908] |
| 27 | [83–310] | [83–157] | [158–310] | [725–730] | [748–762] |
| 28 | [310–906] | [310–357] | [358–906] | [1071–1076] | [1088–1102] |
| 29 | [24–287] | [24–131] | [132–287] | [405–410] | [422–436] |
| 30 | [132–1574] | [132–206] | [207–1574] | [1899–1904] | [1923–1938] |
| 31 | [117–545] | [117–245] | [246–545] | None detected | [1100–1116] |
| 32 | [117–362] | none detected | [117–362] | None detected | [1098–1114] |
| 33 | [144–1262] | [144–224] | [225–1262] | [2035–2040] | [2056–2072] |
| 34 | [35–316] | [35–109] | [110–316] | None detected | [393–409] |
| 35 | [177–767] | [177–236] | [237–767] | None detected | [822–836] |
| 36 | [208–1239] | [208–294] | [295–1239] | None detected | [1307–1323] |
| 37 | [60–1682] | [60–143] | [144–1682] | None detected | [1929–1945] |
| 38 | [198–998] | [198–269] | [270–998] | [1292–1297] | [1315–1330] |
| 39 | [505–1590] | [505–624] | [625–1590] | [2089–2094] | [2108–2124] |
| 40 | [84–326] | [84–146] | [147–326] | [1122–1127] | [1142–1159] |
| 41 | [56–1678] | [56–139] | [140–1678] | None detected | [1936–1953] |
| 42 | [119–1522] | [119–181] | [182–1522] | None detected | [1671–1688] |
| 43 | [334–1551] | [334–426] | [427–1551] | None detected | [1925–1942] |
| 44 | [72–986] | [72–149] | [150–986] | [1608–1613] | [1640–1657] |
| 45 | [157–1482] | [157–219] | [220–1482] | None detected | [1716–1733] |
| 46 | [195–1052] | [195–338] | [339–1052] | None detected | [1854–1871] |
| 47 | [217–1410] | [217–279] | [280–1410] | [1482–1487] | [1507–1536] |
| 48 | [103–492] | [103–162] | [163–492] | [794–799] | [815–832] |
| 49 | [234–491] | [234–293] | [294–491] | [793–798] | [814–831] |
| 50 | [180–800] | [180–248] | [249–800] | [880–885] | [901–917] |
| 51 | [140–472] | [140–211] | [212–472] | None detected | [605–621] |
| 52 | [68–484] | [68–112] | [113–484] | None detected | [657–673] |
| 53 | [38–517] | [38–118] | [119–517] | [861–866] | [885–897] |
| 54 | [92–634] | [92–139] | [140–634] | None detected | None detected |
| 55 | [27–767] | [27–80] | [81–767] | None detected | [1031–1047] |
| 56 | [4–399] | [4–126] | [127–399] | [891–896] | [909–923] |
| 57 | [127–879] | [127–198] | [199–879] | None detected | [1224–1240] |
| 58 | [156–566] | [156–221] | [222–566] | [870–875] | [888–902] |
| 59 | [35–1657] | [35–118] | [119–1657] | None detected | [1955–1969] |
| 60 | [77–937] | [77–127] | [128–937] | [1098–1103] | [1116–1132] |
| 61 | [9–503] | [9–113] | [114–503] | [594–599] | [615–631] |
| 62 | [21–464] | [21–95] | [96–464] | [650–655] | [692–722] |
| 63 | [178–1050] | [178–279] | [280–1050] | [1400–1405] | [1426–1442] |
| 64 | [32–274] | [32–178] | [179–274] | [756–761] | [779–795] |
| 65 | [222–920] | [222–311] | [312–920] | [1191–1196] | [1220–1236] |
| 66 | [101–355] | [101–160] | [161–355] | [772–777] | [788–881] |
| 67 | [173–487] | [173–301] | [302–487] | [486–491] | [508–524] |
| 68 | [210–1082] | [210–311] | [312–1082] | [1432–1437] | [1456–1472] |
| 69 | [172–1449] | [172–255] | [256–1449] | None detected | [1721–1737] |
| 70 | [30–1427] | [30–77] | [78–1427] | [1594–1599] | [1621–1637] |
| 71 | [30–1175] | [30–77] | [78–1175] | [1593–1598] | [1620–1636] |
| 72 | [66–839] | [66–173] | [174–839] | None detected | [1742–1758] |
| 73 | [64–903] | [64–162] | [163–903] | [1612–1617] | [1631–1647] |
| 74 | [64–585] | [64–162] | [163–585] | [1611–1616] | [1630–1646] |
| 75 | [274–753] | [274–324] | [325–753] | [1931–1936] | [1947–1963] |

TABLE II-continued

| Seq Id No | Full coding sequence | Signal sequence | Coding sequence for mature protein | Polyadenylation signal | Polyadenylation site |
|---|---|---|---|---|---|
| 76 | [191–1468] | [191–274] | [275–1468] | None detected | [1741–1757] |
| 77 | [48–950] | [48–107] | [108–950] | [1983–1988] | [2011–2027] |
| 78 | [156–512] | [156–206] | [207–512] | [1831–1836] | [1864–1880] |
| 79 | [67–351] | [67–183] | [184–351] | None detected | [568–584] |
| 80 | [259–831] | [259–375] | [376–831] | None detected | [1337–1351] |
| 81 | [111–377] | [111–233] | [234–377] | [689–694] | [706–720] |
| 82 | [223–432] | [223–336] | [337–432] | [986–991] | [1015–1029] |
| 83 | [769–1272] | [769–843] | [844–1272] | None detected | [1774–1788] |
| 84 | [30–527] | [30–74] | [75–527] | [738–743] | [756–805] |
| 85 | [39–506] | [39–83] | [84–506] | None detected | [800–814] |
| 86 | [115–429] | [115–210] | [211–429] | [565–570] | [584–598] |
| 87 | [332–574] | [332–412] | [413–574] | None detected | [630–699] |
| 88 | [133–417] | [133–213] | [214–417] | [876–881] | [891–905] |
| 89 | [113–364] | [113–172] | [173–364] | None detected | [500–514] |
| 90 | [9–380] | [9–104] | [105–380] | [483–488] | [504–518] |
| 91 | [155–340] | [155–292] | [293–340] | [728–733] | [754–808] |
| 92 | [185–634] | [185–253] | [254–634] | [704–709] | [723–737] |
| 93 | [53–646] | [53–91] | [92–646] | [694–699] | [714–728] |
| 94 | [247–510] | [247–318] | [319–510] | [544–549] | [568–582] |
| 95 | [143–592] | [143–277] | [278–592] | [1877–1882] | [1898–1913] |
| 96 | [33–458] | [33–89] | [90–458] | [637–642] | [654–670] |
| 97 | [1–336] | [1–81] | [82–336] | [900–905] | [923–939] |
| 98 | [174–443] | [174–269] | [270–443] | [629–634] | [647–661] |
| 99 | [282–521] | [282–386] | [387–521] | [600–605] | [631–647] |
| 100 | [251–643] | [251–295] | [296–643] | None detected | [990–1006] |
| 101 | [179–475] | [179–295] | [296–475] | [995–1000] | [1015–1059] |
| 102 | [34–327] | [34–162] | [163–327] | [466–471] | [498–514] |
| 103 | [303–953] | [303–359] | [360–953] | [1124–1129] | [1142–1158] |
| 104 | [97–645] | [97–156] | [157–645] | [1524–1529] | [1547–1563] |
| 105 | [80–820] | [80–118] | [119–820] | [1587–1592] | [1606–1621] |
| 106 | [77–388] | [77–217] | [218–388] | [524–529] | [541–557] |
| 107 | [139–513] | [139–201] | [202–513] | [566–571] | [584–600] |
| 108 | [81–986] | [81–134] | [135–986] | [1092–1097] | [1113–1129] |
| 109 | [266–586] | [266–307] | [308–586] | [745–750] | [762–778] |
| 110 | [59–745] | [59–160] | [161–745] | None detected | [1285–1301] |
| 111 | [59–676] | [59–160] | [161–676] | None detected | [1284–1300] |
| 112 | [15–278] | [15–146] | [147–278] | [1580–1585] | [1600–1617] |
| 113 | [167–619] | [167–262] | [263–619] | [1598–1603] | [1617–1634] |
| 114 | [223–417] | [223–270] | [271–417] | [655–660] | [677–693] |
| 115 | [166–732] | [166–237] | [238–732] | [753–758] | [768–784] |
| 116 | [75–623] | [75–215] | [216–623] | [767–772] | [788–804] |
| 117 | [30–335] | [30–71] | [72–335] | [450–455] | [468–484] |
| 118 | [21–752] | [21–107] | [108–752] | None detected | [970–985] |
| 119 | [185–715] | [185–253] | [254–715] | [785–790] | [814–839] |
| 120 | [54–527] | [54–116] | [117–527] | [545–550] | [567–583] |
| 121 | [129–686] | [129–185] | [186–686] | [989–994] | [1008–1024] |
| 122 | [165–614] | [165–305] | [306–614] | [719–724] | [744–760] |
| 123 | [192–476] | [192–326] | [327–476] | [555–560] | [578–594] |
| 124 | [16–297] | [16–93] | [94–297] | None detected | [543–559] |
| 125 | [216–635] | [216–335] | [336–635] | [717–722] | [728–744] |
| 126 | [164–280] | [164–268] | [269–280] | [789–794] | [809–824] |
| 127 | [68–301] | [68–190] | [191–301] | [485–490] | [510–526] |
| 128 | [179–427] | [179–298] | [299–427] | [579–584] | [602–618] |
| 129 | [22–297] | [22–66] | [67–297] | [742–747] | [760–776] |
| 130 | [9–845] | [9–134] | [135–845] | [964–969] | [983–998] |
| 131 | [27–578] | [27–119] | [120–578] | [742–747] | [763–779] |
| 132 | [408–710] | [408–533] | [534–710] | [985–990] | [1009–1025] |
| 133 | [247–501] | [247–306] | [307–501] | None detected | [592–607] |
| 134 | [333–602] | [333–416] | [417–602] | None detected | [761–774] |
| 135 | [110–376] | [110–208] | [209–376] | [582–587] | [601–611] |
| 136 | [22–417] | [22–66] | [67–417] | [888–893] | [909–925] |
| 137 | [62–367] | [62–103] | [104–367] | [638–643] | [658–674] |
| 138 | [107–1618] | [107–178] | [179–1618] | [1688–1693] | [1709–1725] |
| 139 | [16–471] | [16–93] | [94–471] | None detected | [1458–1474] |
| 140 | [222–374] | [222–299] | [300–374] | None detected | [637–653] |
| 141 | [59–274] | [59–127] | [128–274] | [1452–1457] | [1474–1490] |
| 142 | [158–442] | [158–301] | [302–442] | [621–626] | [645–661] |
| 143 | [5–454] | [5–64] | [65–454] | [1745–1750] | [1773–1789] |
| 144 | [241–1302] | none detected | [241–1302] | [1968–1973] | [1990–2006] |
| 145 | [15–635] | none detected | [15–635] | [1057–1062] | [1080–1096] |
| 146 | [109–738] | none detected | [109–738] | [1633–1638] | [1650–1666] |
| 147 | [21–1145] | none detected | [21–1145] | [1648–1653] | [1666–1687] |
| 148 | [70–1596] | none detected | [70–1596] | [1712–1717] | [1733–1747] |
| 149 | [129–362] | none detected | [129–362] | [597–602] | [626–658] |
| 150 | [109–594] | none detected | [109–594] | [1999–2004] | [2029–2045] |

TABLE II-continued

| Seq Id No | Full coding sequence | Signal sequence | Coding sequence for mature protein | Polyadenylation signal | Polyadenylation site |
|---|---|---|---|---|---|
| 151 | [150–587] | none detected | [150–587] | None detected | [772–788] |
| 152 | [173–847] | none detected | [173–847] | [1894–1899] | [1915–1931] |
| 153 | [100–441] | none detected | [100–441] | [479–484] | [500–514] |
| 154 | [32–1132] | none detected | [32–1132] | None detected | [1167–1183] |
| 155 | [160–996] | none detected | [160–996] | [1504–1509] | [1529–1545] |
| 156 | [11–529] | none detected | [11–529] | [1042–1047] | [1053–1068] |
| 157 | [135–749] | none detected | [135–749] | [1055–1060] | [1081–1097] |
| 158 | [98–637] | none detected | [98–637] | [862–867] | [878–894] |
| 159 | [221–670] | none detected | [221–670] | [669–674] | [688–703] |
| 160 | [165–674] | none detected | [165–674] | [808–813] | [833–849] |
| 161 | [165–671] | none detected | [165–671] | [805–810] | [830–846] |
| 162 | [28–1128] | none detected | [28–1128] | [1121–1126] | [1159–1176] |
| 163 | [135–194] | none detected | [135–194] | [1050–1055] | [1068–1084] |
| 164 | [173–847] | none detected | [173–847] | [1757–1762] | [1776–1793] |
| 165 | [8–1141] | none detected | [8–1141] | None detected | [1832–1849] |
| 166 | [136–264] | none detected | [136–264] | [1720–1725] | [1731–1748] |
| 167 | [14–1048] | none detected | [14–1048] | [1234–1239] | [1258–1275] |
| 168 | [70–777] | none detected | [70–777] | [987–992] | [1007–1023] |
| 169 | [38–400] | none detected | [38–400] | [1043–1048] | [1069–1085] |
| 170 | [63–572] | none detected | [63–572] | [750–755] | [767–776] |
| 171 | [160–867] | none detected | [160–867] | [1178–1183] | [1203–1219] |
| 172 | [68–640] | none detected | [68–640] | None detected | [1471–1487] |
| 173 | [132–1298] | none detected | [132–1298] | [1873–1878] | [1899–1915] |
| 174 | [259–1701] | none detected | [259–1701] | None detected | [1974–1990] |
| 175 | [213–1274] | none detected | [213–1274] | [1940–1945] | [1955–1971] |
| 176 | [68–127] | none detected | [68–127] | None detected | [1597–1613] |
| 177 | [65–1024] | none detected | [65–1024] | [1291–1296] | [1315–1361] |
| 178 | [109–585] | none detected | [109–585] | [1059–1064] | [1082–1113] |
| 179 | [29–577] | none detected | [29–577] | [1917–1922] | [1944–1960] |
| 180 | [23–451] | none detected | [23–451] | [1405–1410] | [1427–1443] |
| 181 | [232–450] | none detected | [232–450] | None detected | [589–605] |
| 182 | [758–1183] | none detected | [758–1183] | None detected | [1708–1724] |
| 183 | [486–932] | none detected | [486–932] | None detected | [1670–1686] |
| 184 | [80–304] | none detected | [80–304] | None detected | [452–463] |
| 185 | [188–691] | none detected | [188–691] | [707–712] | [727–773] |
| 186 | [94–573] | none detected | [94–573] | None detected | [739–753] |
| 187 | [181–462] | none detected | [181–462] | None detected | [740–754] |
| 188 | [6–290] | none detected | [6–290] | None detected | [971–998] |
| 189 | [115–411] | none detected | [115–411] | [573–578] | [591–605] |
| 190 | [3–368] | none detected | [3–368] | [481–486] | [511–526] |
| 191 | [174–527] | none detected | [174–527] | [878–883] | [896–910] |
| 192 | [57–203] | none detected | [57–203] | [579–584] | [599–668] |
| 193 | [68–334] | none detected | [68–334] | [562–567] | [583–637] |
| 194 | [183–443] | none detected | [183–443] | [670–675] | [692–706] |
| 195 | [94–228] | none detected | [94–228] | None detected | [656–670] |
| 196 | [133–327] | none detected | [133–327] | [465–470] | [496–510] |
| 197 | [22–357] | none detected | [22–357] | None detected | [486–500] |
| 198 | [4–333] | none detected | [4–333] | [633–638] | [653–667] |
| 199 | [1–363] | none detected | [1–363] | [474–479] | [498–514] |
| 200 | [41–337] | none detected | [41–337] | None detected | [401–462] |
| 201 | [1–551] | none detected | [1–551] | None detected | [535–551] |
| 202 | [34–315] | none detected | [34–315] | None detected | [534–550] |
| 203 | [1–315] | none detected | [1–315] | [371–376] | [392–408] |
| 204 | [94–582] | none detected | [94–582] | None detected | [651–665] |
| 205 | [540–923] | none detected | [540–923] | None detected | [994–1008] |
| 206 | [77–364] | none detected | [77–364] | [367–372] | [391–455] |
| 207 | [65–544] | none detected | [65–544] | [710–715] | [733–749] |
| 208 | [117–467] | none detected | [117–467] | [557–562] | [578–594] |
| 209 | [893–1897] | none detected | [893–1897] | [2066–2071] | [2082–2098] |
| 210 | [85–342] | none detected | [85–342] | None detected | [412–428] |
| 211 | [155–433] | none detected | [155–433] | [713–718] | [735–769] |
| 212 | [63–386] | none detected | [63–386] | [878–883] | [898–914] |
| 213 | [460–1290] | none detected | [460–1290] | [1449–1454] | [1473–1489] |
| 214 | [21–539] | none detected | [21–539] | [741–746] | [760–776] |
| 215 | [34–1143] | none detected | [34–1143] | [1375–1380] | [1397–1412] |
| 216 | [6–1184] | none detected | [6–1184] | [1735–1740] | [1744–1773] |
| 217 | [29–376] | none detected | [29–376] | None detected | [1184–1251] |
| 218 | [78–566] | none detected | [78–566] | [858–863] | [878–894] |
| 219 | [16–705] | none detected | [16–705] | [868–873] | [894–910] |
| 220 | [103–405] | none detected | [103–405] | [482–487] | [503–519] |
| 221 | [72–350] | none detected | [72–350] | [593–598] | [616–632] |
| 222 | [38–436] | none detected | [38–436] | None detected | [636–652] |
| 223 | [38–322] | none detected | [38–322] | None detected | [634–650] |
| 224 | [202–480] | none detected | [202–480] | [472–477] | [488–502] |
| 225 | [171–1670] | none detected | [171–1670] | [1706–1711] | [1725–1739] |

TABLE II-continued

| Seq Id No | Full coding sequence | Signal sequence | Coding sequence for mature protein | Polyadenylation signal | Polyadenylation site |
|---|---|---|---|---|---|
| 226 | [199–618] | none detected | [199–618] | [626–631] | [643–657] |
| 227 | [182–481] | none detected | [182–481] | None detected | [874–888] |
| 228 | [161–517] | none detected | [161–517] | None detected | [701–716] |
| 229 | [86–505] | none detected | [86–505] | [618–623] | [638–654] |
| 230 | [56–382] | none detected | [56–382] | [598–603] | [619–635] |
| 231 | [56–355] | none detected | [56–355] | [597–602] | [618–634] |
| 232 | [76–498] | none detected | [76–498] | [546–551] | [567–583] |
| 233 | [199–600] | none detected | [199–600] | [705–710] | [737–753] |
| 234 | [211–612] | none detected | [211–612] | [717–722] | [746–762] |
| 235 | [5–259] | none detected | [5–259] | [502–507] | [521–537] |
| 236 | [23–370] | none detected | [23–370] | [956–961] | [978–994] |
| 237 | [41–352] | none detected | [41–352] | None detected | [646–662] |
| 238 | [3–1319] | none detected | [3–1319] | [1791–1796] | [1813–1829] |
| 239 | [421–768] | none detected | [421–768] | [1045–1050] | [1067–1083] |
| 240 | [78–590] | none detected | [78–590] | None detected | [1815–1831] |
| 241 | [78–608] | none detected | [78–608] | None detected | [1814–1830] |

TABLE III

List of variants

92; 119
14; 15
110; 111
69; 174; 76
2; 12
172; 176; 177
150; 152; 164; 166
154; 162
77; 143
34; 62
230; 231
63; 68
8; 47
48; 49; 66
7; 72
160; 161
144; 175
17; 21
31; 32
5; 6
3; 10
96; 121
37; 41; 59
70; 71
19; 24
186; 195; 204
73; 74
240; 241
221; 235
222; 223
42; 45
157; 163
190; 229
117; 137
122; 233; 234
201; 202
80; 139

TABLE IV

| Seq Id No | Preferentially excluded fragments |
|---|---|
| 1 | 192 . . . 235; 2099 . . . 2201 |
| 2 | 174 . . . 225; 1605 . . . 1631 |
| 3 | 1111 . . . 1245 |
| 4 | 1590 . . . 1598; 1607 . . . 1623 |
| 5 | 1385 . . . 1453 |
| 6 | 1571 . . . 1639 |
| 7 | 1732 . . . 1768 |
| 8 | 1494 . . . 1510 |
| 9 | 570 . . . 882 |
| 10 | 1176 . . . 1218; 1710 . . . 1742; 1833 . . . 1849 |
| 11 | 219 . . . 253; 455 . . . 565 |
| 12 | 178 . . . 229; 1636 . . . 1663 |
| 13 | 729 . . . 744 |
| 14 | 790 . . . 827; 1735 . . . 1759 |
| 15 | 788 . . . 825; 1731 . . . 1755 |
| 16 | 922 . . . 936 |
| 17 | 668 . . . 747 |
| 18 | 1870 . . . 1884 |
| 19 | 677 . . . 691 |
| 20 | 1124 . . . 1138 |
| 21 | 450 . . . 468 |
| 22 | 393 . . . 411; 706 . . . 720 |
| 23 | 713 . . . 727 |
| 24 | 456 . . . 470 |
| 25 | 876 . . . 928; 973 . . . 987 |
| 26 | 894 . . . 908 |
| 27 | 748 . . . 762 |
| 28 | 1088 . . . 1102 |
| 29 | 422 . . . 436 |
| 30 | 1879 . . . 1918; 1923 . . . 1938 |
| 31 | 774 . . . 1116 |
| 32 | 772 . . . 1114 |
| 33 | 2056 . . . 2072 |
| 34 | 393 . . . 409 |
| 35 | 784 . . . 836 |
| 36 | 544 . . . 551; 1307 . . . 1323 |
| 37 | 1867 . . . 1874; 1929 . . . 1945 |
| 38 | 1315 . . . 1330 |
| 39 | 2108 . . . 2124 |
| 40 | 413 . . . 421; 1116 . . . 1159 |
| 41 | 1863 . . . 1870; 1936 . . . 1953 |
| 42 | 1623 . . . 1688 |
| 43 | 1895 . . . 1942 |
| 44 | 1640 . . . 1657 |
| 45 | 1661 . . . 1733 |
| 46 | 1555 . . . 1871 |
| 47 | 1507 . . . 1523 |
| 48 | 541 . . . 832 |
| 49 | 540 . . . 831 |
| 50 | 901 . . . 917 |
| 51 | 2 . . . 10; 605 . . . 621 |
| 52 | 585 . . . 673 |
| 53 | 885 . . . 897 |
| 54 | 4 . . . 13; 761 . . . 1101 |
| 55 | 1031 . . . 1047 |
| 56 | 873 . . . 905; 907 . . . 923 |

TABLE IV-continued

| Seq Id No | Preferentially excluded fragments |
|---|---|
| 57 | 1224 ... 1240 |
| 58 | 861 ... 902 |
| 59 | 1842 ... 1849; 1955 ... 1969 |
| 60 | 1116 ... 1132 |
| 61 | 15 ... 46; 615 ... 631 |
| 62 | 651 ... 722 |
| 63 | 1426 ... 1442 |
| 64 | 739 ... 795 |
| 65 | 1220 ... 1236 |
| 66 | 520 ... 881 |
| 67 | 413 ... 524 |
| 68 | 1444 ... 1472 |
| 69 | 1721 ... 1737 |
| 70 | 1621 ... 1637 |
| 71 | 1620 ... 1636 |
| 72 | 777 ... 784; 1742 ... 1758 |
| 73 | 1631 ... 1647 |
| 74 | 1630 ... 1646 |
| 75 | 1947 ... 1963 |
| 76 | 1741 ... 1757 |
| 77 | 1561 ... 1913; 2011 ... 2027 |
| 78 | 727 ... 819; 880 ... 894; 901 ... 1280; 1841 ... 1880 |
| 79 | 418 ... 584 |
| 80 | 331 ... 353; 844 ... 1214; 1337 ... 1351 |
| 81 | 706 ... 720 |
| 82 | 639 ... 713; 1008 ... 1029 |
| 83 | 1454 ... 1788 |
| 84 | 712 ... 805 |
| 85 | 800 ... 814 |
| 86 | 584 ... 598 |
| 87 | 122 ... 308; 593 ... 699 |
| 88 | 855 ... 905 |
| 89 | 500 ... 514 |
| 90 | 81 ... 101; 198 ... 205; 504 ... 518 |
| 91 | 650 ... 808 |
| 92 | 128 ... 201; 723 ... 737 |
| 93 | 714 ... 728 |
| 94 | 568 ... 582 |
| 95 | 1761 ... 1773; 1898 ... 1913 |
| 96 | 654 ... 670 |
| 97 | 883 ... 938 |
| 98 | 616 ... 661 |
| 99 | 631 ... 647 |
| 100 | 853 ... 1006 |
| 101 | 537 ... 544; 949 ... 1059 |
| 102 | 498 ... 514 |
| 103 | 1142 ... 1158 |
| 104 | 1524 ... 1563 |
| 105 | 1230 ... 1259; 1606 ... 1621 |
| 106 | 505 ... 557 |
| 107 | 584 ... 600 |
| 108 | 378 ... 385; 1113 ... 1129 |
| 109 | 729 ... 778 |
| 110 | 992 ... 1301 |
| 111 | 991 ... 1300 |
| 112 | 1131 ... 1139; 1569 ... 1617 |
| 113 | 1526 ... 1634 |
| 114 | 457 ... 509; 677 ... 693 |
| 115 | 768 ... 784 |
| 116 | 360 ... 670; 788 ... 804 |
| 117 | 435 ... 484 |
| 118 | 433 ... 452; 764 ... 985 |
| 119 | 128 ... 201; 801 ... 839 |
| 120 | 554 ... 564; 567 ... 583 |
| 121 | 872 ... 908; 1008 ... 1024 |
| 122 | 744 ... 760 |
| 123 | 578 ... 594 |
| 124 | 94 ... 102; 248 ... 559 |
| 125 | 728 ... 744 |
| 126 | 809 ... 824 |
| 127 | 510 ... 526 |
| 128 | 602 ... 618 |
| 129 | 472 ... 553; 569 ... 776 |
| 130 | 983 ... 998 |
| 131 | 396 ... 468; 763 ... 779 |
| 132 | 478 ... 532; 1009 ... 1025 |
| 133 | 592 ... 607 |
| 134 | 761 ... 774 |
| 135 | 556 ... 563; 601 ... 611 |
| 136 | 887 ... 919 |
| 137 | 658 ... 674 |
| 138 | 1651 ... 1725 |
| 139 | 49 ... 71; 988 ... 1358; 1458 ... 1474 |
| 140 | 324 ... 653 |
| 141 | 720 ... 730; 1449 ... 1490 |
| 142 | 44 ... 119; 498 ... 505; 578 ... 585; 645 ... 661 |
| 143 | 1322 ... 1666; 1773 ... 1789 |
| 144 | 1828 ... 1897; 1919 ... 1968; 1990 ... 2006 |
| 145 | 936 ... 955; 1060 ... 1096 |
| 146 | 778 ... 827; 1650 ... 1666 |
| 147 | 1170 ... 1207; 1647 ... 1687 |
| 148 | 1733 ... 1747 |
| 149 | 579 ... 658 |
| 150 | 1432 ... 1440; 1728 ... 1778; 2004 ... 2045 |
| 151 | 772 ... 788 |
| 152 | 1496 ... 1504; 1792 ... 1842; 1915 ... 1931 |
| 153 | 500 ... 514 |
| 154 | 1167 ... 1183 |
| 155 | 1529 ... 1545 |
| 156 | 703 ... 1068 |
| 157 | 873 ... 881; 1081 ... 1097 |
| 158 | 878 ... 894 |
| 159 | 688 ... 703 |
| 160 | 833 ... 849 |
| 161 | 830 ... 846 |
| 162 | 1159 ... 1176 |
| 163 | 869 ... 876; 1068 ... 1084 |
| 164 | 1444 ... 1463; 1496 ... 1504; 1743 ... 1793 |
| 165 | 1233 ... 1319; 1697 ... 1849 |
| 166 | 1407 ... 1426; 1459 ... 1467; 1694 ... 1748 |
| 167 | 1258 ... 1275 |
| 168 | 84 ... 129; 1002 ... 1023 |
| 169 | 436 ... 472; 596 ... 604; 673 ... 689; 732 ... 954; 995 ... 1085 |
| 170 | 767 ... 776 |
| 171 | 1203 ... 1219 |
| 172 | 1411 ... 1487 |
| 173 | 1861 ... 1915 |
| 174 | 1974 ... 1990 |
| 175 | 1800 ... 1869; 1891 ... 1940; 1955 ... 1971 |
| 176 | 1597 ... 1613 |
| 177 | 186 ... 212; 1277 ... 1361 |
| 178 | 930 ... 978; 1002 ... 1113 |
| 179 | 951 ... 1000; 1364 ... 1533; 1944 ... 1960 |
| 180 | 1427 ... 1443 |
| 181 | 107 ... 181; 276 ... 311; 449 ... 605 |
| 182 | 1143 ... 1450; 1677 ... 1724 |
| 183 | 1 ... 251; 648 ... 655; 1347 ... 1686 |
| 184 | 447 ... 463 |
| 185 | 150 ... 159; 623 ... 773 |
| 186 | 340 ... 476; 739 ... 753 |
| 187 | 740 ... 754 |
| 188 | 307 ... 315; 668 ... 998 |
| 189 | 118 ... 125; 529 ... 536; 591 ... 605 |
| 190 | 492 ... 526 |
| 191 | 872 ... 910 |
| 192 | 525 ... 668 |
| 193 | 91 ... 135; 461 ... 637 |
| 194 | 392 ... 458; 551 ... 671; 692 ... 706 |
| 195 | 656 ... 670 |
| 196 | 283 ... 379; 458 ... 466; 496 ... 510 |
| 197 | 1 ... 96; 483 ... 500 |
| 198 | 625 ... 667 |
| 199 | 474 ... 513 |
| 200 | 370 ... 462 |
| 201 | 535 ... 551 |
| 202 | 534 ... 550 |
| 203 | 374 ... 408 |
| 204 | 651 ... 665 |
| 205 | 994 ... 1008 |
| 206 | 348 ... 455 |
| 207 | 733 ... 749 |
| 208 | 1 ... 49; 578 ... 594 |
| 209 | 2082 ... 2098 |

TABLE IV-continued

| Seq Id No | Preferentially excluded fragments |
|---|---|
| 210 | 412 . . . 428 |
| 211 | 689 . . . 769 |
| 212 | 898 . . . 914 |
| 213 | 1266 . . . 1489 |
| 214 | 760 . . . 776 |
| 215 | 1304 . . . 1311; 1383 . . . 1412 |
| 216 | 648 . . . 691; 1711 . . . 1773 |
| 217 | 644 . . . 856; 910 . . . 1251 |
| 218 | 878 . . . 894 |
| 219 | 894 . . . 910 |
| 220 | 503 . . . 519 |
| 221 | 616 . . . 632 |
| 222 | 636 . . . 652 |
| 223 | 634 . . . 650 |
| 224 | 50 . . . 57; 488 . . . 502 |
| 225 | 534 . . . 577; 1725 . . . 1739 |
| 226 | 643 . . . 657 |
| 227 | 1 . . . 84; 874 . . . 888 |
| 228 | 701 . . . 716 |
| 229 | 638 . . . 654 |
| 230 | 263 . . . 573; 619 . . . 635 |
| 231 | 263 . . . 573; 619 . . . 635 |
| 232 | 567 . . . 583 |
| 233 | 737 . . . 753 |
| 234 | 746. . . 762 |
| 235 | 499 . . . 537 |
| 236 | 905 . . . 912; 944 . . . 994 |
| 237 | 348 . . . 662 |
| 239 | 829 . . . 1083 |
| 240 | 1508 . . . 1831 |
| 241 | 1507 . . . 1830 |

TABLE Va

| Seq Id No | Preferentially excluded fragments | Preferentially included fragments |
|---|---|---|
| 1 | [1–540]; [556–615]; [2061–2096]; [2098–2201] | [541–555]; [616–2060]; [2097–2097] |
| 2 | [1–511]; [533–619]; [621–690]; [730–1132] | [512–532]; [620–620]; [691–729]; [1133–1631] |
| 3 | [2–539]; [1178–1245] | [1–1]; [540–1177] |
| 4 | [1–250]; [297–383]; [386–514]; [1025–1064] | [251–296]; [384–385]; [515–1024]; [1065–1623] |
| 5 | [27–116]; [118–391] | [1–26]; [117–117]; [392–1454] |
| 6 | [1–93]; [96–168]; [170–262]; [264–461] | [94–95]; [169–169]; [263–263]; [462–1639] |
| 7 | [1–95]; [97–451] | [96–96]; [452–1768] |
| 8 | [1–502]; [1314–1491] | [503–1313]; [1492–1510] |
| 9 | [1–864] | [865–882] |
| 10 | [1–428] | [429–1849] |
| 11 | [1–454]; [482–514] | [455–481]; [515–565] |
| 12 | [1–375]; [379–511]; [533–690]; [730–783]; [814–1164] | [376–378]; [512–532]; [691–729]; [784–813]; [1165–1663] |
| 13 | [2–337]; [339–556] | [1–1]; [338–338]; [557–744] |
| 14 | [29–366]; [368–507] | [1–28]; [367–367]; [508–1759] |
| 15 | [29–366]; [368–524] | [1–28]; [367–367]; [525–1755] |
| 16 | [1–641] | [642–936] |
| 17 | [1–708]; [711–747] | [709–710] |
| 18 | [1–639] | [640–1884] |
| 19 | [1–631] | [632–691] |
| 20 | [3–416]; [418–490] | [1–2]; [417–417]; [491–1138] |
| 21 | [1–468] | None |
| 22 | [1–720] | None |
| 23 | [1–711] | [712–727] |
| 24 | [1–469] | [470–470] |
| 25 | [1–231]; [234–488] | [232–233]; [489–987] |
| 26 | [1–296]; [300–642]; [644–737] | [297–299]; [643–643]; [738–908] |
| 27 | [1–306]; [308–762] | [307–307] |
| 28 | [1–446]; [448–1102] | [447–447] |
| 29 | [1–436] | None |
| 30 | [7–334]; [1420–1468]; [1474–1614]; [1616–1804]; [1845–1919] | [1–6]; [335–1419]; [1469–1473]; [1615–1615]; [1805–1844]; [1920–1938] |
| 31 | [1–342]; [345–519]; [823–893]; [977–1016] | [343–344]; [520–822]; [894–976]; [1017–1116] |
| 32 | [1–517]; [821–891]; [975–1014] | [518–820]; [892–974]; [1015–1114] |
| 33 | [36–352]; [354–457]; [728–832]; [834–1096]; [1253–1289]; [1291–1350]; [1352–1412]; [1726–1873] | [1–35]; [353–353]; [458–727]; [833–833]; [1097–1252]; [1290–1290]; [1351–1351]; [1413–1725]; [1874–2072] |
| 34 | [1–409] | None |
| 35 | [14–105] | [1–13]; [106–836] |
| 36 | [1–572]; [1120–1271] | [573–1119]; [1272–1323] |
| 37 | [20–98]; [100–510]; [1591–1681]; [1683–1870] | [1–19]; [99–99]; [511–1590]; [1682–1682]; [1871–1945] |

TABLE Va-continued

| Seq Id No | Preferentially excluded fragments | Preferentially included fragments |
|---|---|---|
| 38 | [1–547] | [548–1330] |
| 39 | [1–445] | [446–2124] |
| 40 | [1–473]; [475–528] | [474–474]; [529–1159] |
| 41 | [16–506]; [1587–1866] | [1–15]; [507–1586]; [1867–1953] |
| 42 | [2–234]; [244–451]; [974–1226] | [1–1]; [235–243]; [452–973]; [1227–1688] |
| 43 | [1–455]; [1670–1925] | [456–1669]; [1926–1942] |
| 44 | [1–579]; [815–1031] | [580–814]; [1032–1657] |
| 45 | [1–489]; [1012–1264] | [490–1011]; [1265–1733] |
| 46 | [1–400]; [1184–1223]; [1225–1705]; [1740–1818] | [401–1183]; [1224–1224]; [1706–1739]; [1819–1871] |
| 47 | [1–529]; [1326–1505] | [530–1325]; [1506–1523] |
| 48 | [1–131]; [133–510]; [560–589] | [132–132]; [511–559]; [590–832] |
| 49 | [1–130]; [132–509]; [559–588] | [131–131]; [510–558]; [589–831] |
| 50 | [1–650]; [652–868]; [873–913] | [651–651]; [869–872]; [914–917] |
| 51 | [1–504]; [515–605] | [505–514]; [606–621] |
| 52 | [1–535] | [536–673] |
| 53 | [2–563] | [1–1]; [564–897] |
| 54 | [1–527]; [802–870]; [882–934]; [966–1018]; [1037–1080] | [528–801]; [871–881]; [935–965]; [1019–1036]; [1081–1101] |
| 55 | [1–326]; [328–505] | [327–327]; [506–1047] |
| 56 | [1–340] | [341–925] |
| 57 | [1–528] | [529–1240] |
| 58 | [1–108]; [115–151]; [154–340]; [342–529] | [109–114]; [152–153]; [341–341]; [530–902] |
| 59 | [4–485]; [1566–1656]; [1658–1845] | [1–3]; [486–1565]; [1657–1657]; [1846–1969] |
| 60 | [1–283] | [284–1132] |
| 61 | [9–468] | [1–8]; [469–631] |
| 62 | [1–525]; [689–722] | [526–688] |
| 63 | [1–88]; [90–192]; [194–265]; [296–409] | [89–89]; [193–193]; [266–295]; [410–1442] |
| 64 | [1–517] | [518–795] |
| 65 | [1–406]; [408–739] | [407–407]; [740–1236] |
| 66 | [1–489]; [849–881] | [490–848] |
| 67 | [1–505] | [506–524] |
| 68 | [1–325]; [328–441]; [444–504] | [326–327]; [442–443]; [505–1472] |
| 69 | [1–524]; [636–715]; [717–809]; [811–885]; [1567–1715] | [525–635]; [716–716]; [810–810]; [886–1566]; [1716–1737] |
| 70 | [12–487] | [1–11]; [488–1637] |
| 71 | [12–487] | [1–11]; [488–1636] |
| 72 | [1–451] | [452–1758] |
| 73 | [1–167]; [242–464] | [168–241]; [465–1647] |
| 74 | [1–167]; [242–464] | [168–241]; [465–1646] |
| 75 | [1–471] | [472–1963] |
| 76 | [1–358]; [360–543]; [655–734]; [736–828]; [830–904]; [1586–1734] | [359–359]; [544–654]; [735–735]; [829–829]; [905–1585]; [1735–1757] |
| 77 | [3–34]; [36–474]; [582–770]; [1709–1746]; [1748–1785]; [1825–1899] | [1–2]; [35–35]; [475–581]; [771–1708]; [1747–1747]; [1786–1824]; [1900–2027] |
| 78 | [1–75]; [77–319]; [914–1052]; [1063–1126]; [1168–1203] | [76–76]; [320–913]; [1053–1062]; [1127–1167]; [1204–1880] |
| 79 | [1–425] | [426–584] |
| 80 | [1–752]; [947–1017]; [1084–1170] | [753–946]; [1018–1083]; [1171–1351] |
| 81 | [1–496]; [498–720] | [497–497] |
| 82 | [1–324] | [325–1029] |
| 83 | [1–477]; [1474–1529]; [1537–1566]; [1577–1616]; [1622–1662]; [1717–1753] | [478–1473]; [1530–1536]; [1567–1576]; [1617–1621]; [1663–1716]; [1754–1788] |
| 84 | [1–496]; [499–568]; [752–805] | [497–498]; [569–751] |
| 85 | [1–527] | [528–814] |
| 86 | [1–360] | [361–598] |
| 87 | [1–78]; [80–583]; [625–699] | [79–79]; [584–624] |
| 88 | [1–889] | [890–905] |
| 89 | [1–513] | [514–514] |
| 90 | [1–122]; [124–155]; [157–435]; [437–517] | [123–123]; [156–156]; [436–436]; [518–518] |
| 91 | [1–133]; [165–808] | [134–164] |
| 92 | [1–725] | [726–737] |
| 93 | [1–409] | [410–728] |
| 94 | [1–331] | [332–582] |
| 95 | [1–410] | [411–1913] |
| 96 | [1–501] | [502–670] |
| 97 | [1–141]; [143–431] | [142–142]; [432–939] |
| 98 | [1–193] | [194–661] |
| 99 | [1–629] | [630–647] |
| 100 | [1–520]; [862–954]; [976–1005] | [521–861]; [955–975]; [1006–1006] |
| 101 | [1–489]; [581–961]; [1010–1059] | [490–580]; [962–1009] |
| 102 | [1–485] | [486–514] |
| 103 | [1–540] | [541–1158] |
| 104 | [1–556] | [557–1563] |
| 105 | [1–868]; [870–1006] | [869–869]; [1007–1621] |
| 106 | [1–491] | [492–557] |

TABLE Va-continued

| Seq Id No | Preferentially excluded fragments | Preferentially included fragments |
|---|---|---|
| 107 | [1–573] | [574–600] |
| 108 | [1–457]; [586–1110] | [458–585]; [1111–1129] |
| 109 | [1–521]; [655–778] | [522–654] |
| 110 | [1–416]; [478–614]; [616–990]; [992–1065]; [1068–1283] | [417–477]; [615–615]; [991–991]; [1066–1067]; [1284–1301] |
| 111 | [1–416]; [478–614]; [628–989]; [991–1064]; [1067–1282] | [417–477]; [615–627]; [990–990]; [1065–1066]; [1283–1300] |
| 112 | [2–429]; [1161–1202]; [1212–1388]; [1392–1589] | [1–1]; [430–1160]; [1203–1211]; [1389–1391]; [1590–1617] |
| 113 | [1–487] | [488–1634] |
| 114 | [1–70]; [86–496] | [71–85]; [497–693] |
| 115 | [1–358]; [360–558] | [359–359]; [559–784] |
| 116 | [1–215]; [218–495]; [527–607] | [216–217]; [496–526]; [608–804] |
| 117 | [1–466] | [467–484] |
| 118 | [1–515]; [906–963] | [516–905]; [964–985] |
| 119 | [1–744]; [746–816] | [745–745]; [817–839] |
| 120 | [1–85]; [87–521] | [86–86]; [522–583] |
| 121 | [1–532] | [533–1024] |
| 122 | [1–318]; [325–517]; [567–660] | [319–324]; [518–566]; [661–760] |
| 123 | [1–498] | [499–594] |
| 124 | [1–427] | [428–559] |
| 125 | [1–642] | [643–744] |
| 126 | [1–341]; [350–696] | [342–349]; [697–824] |
| 127 | [1–482] | [483–526] |
| 128 | [1–338] | [339–618] |
| 129 | [1–191]; [193–429]; [450–678] | [192–192]; [430–449]; [679–776] |
| 130 | [19–463]; [465–544] | [1–18]; [464–464]; [545–998] |
| 131 | [1–470] | [471–779] |
| 132 | [1–533] | [534–1025] |
| 133 | [1–498] | [499–607] |
| 134 | [1–168]; [170–326]; [328–471]; [552–738] | [169–169]; [327–327]; [472–551]; [739–774] |
| 135 | [1–346]; [348–395]; [440–473] | [347–347]; [396–439]; [474–611] |
| 136 | [1–324]; [343–436] | [325–342]; [437–925] |
| 137 | [1–186]; [188–251]; [255–517] | [187–187]; [252–254]; [518–674] |
| 138 | [1–488] | [489–1725] |
| 139 | [1–101]; [103–190]; [292–327]; [1091–1161]; [1228–1314] | [102–102]; [191–291]; [328–1090]; [1162–1227]; [1315–1474] |
| 140 | [1–465]; [516–653] | [466–515] |
| 141 | [1–761]; [763–857]; [912–1326] | [762–762]; [858–911]; [1327–1490] |
| 142 | [1–476] | [477–661] |
| 143 | [1–531]; [1471–1508]; [1510–1547]; [1587–1661] | [532–1470]; [1509–1509]; [1548–1586]; [1662–1789] |
| 144 | [1–492]; [503–536] | [493–502]; [537–2006] |
| 145 | [1–570] | [571–1096] |
| 146 | [1–536]; [621–703]; [729–1075]; [1198–1445] | [537–620]; [704–728]; [1076–1197]; [1446–1666] |
| 147 | [1–555]; [578–628] | [556–577]; [629–1687] |
| 148 | [1–444]; [1201–1474]; [1480–1516] | [445–1200]; [1475–1479]; [1517–1747] |
| 149 | [1–613]; [626–658] | [614–625] |
| 150 | [4–199]; [201–419]; [421–492] | [1–3]; [200–200]; [420–420]; [493–2045] |
| 151 | [1–509] | [510–788] |
| 152 | [1–483]; [485–578] | [484–484]; [579–1931] |
| 153 | [1–497] | [498–514] |
| 154 | [5–509]; [579–763]; [765–1162] | [1–4]; [510–578]; [764–764]; [1163–1183] |
| 155 | [1–486]; [1095–1500] | [487–1094]; [1501–1545] |
| 156 | [1–488]; [740–797]; [799–884]; [895–974] | [489–739]; [798–798]; [885–894]; [975–1068] |
| 157 | [1–161]; [163–565]; [567–701] | [162–162]; [566–566]; [702–1097] |
| 158 | [1–496]; [692–754] | [497–691]; [755–894] |
| 159 | [1–483] | [484–703] |
| 160 | [1–494] | [495–849] |
| 161 | [1–491] | [492–846] |
| 162 | [1–505]; [575–759]; [761–1164] | [506–574]; [760–760]; [1165–1176] |
| 163 | [1–699] | [700–1084] |
| 164 | [38–483]; [485–556] | [1–37]; [484–484]; [557–1793] |
| 165 | [1–426]; [1303–1444]; [1717–1755]; [1787–1825] | [427–1302]; [1445–1716]; [1756–1786]; [1826–1849] |
| 166 | [2–264]; [266–446]; [448–519] | [1–1]; [265–265]; [447–447]; [520–1748] |
| 167 | [1–519]; [523–552] | [520–522]; [553–1275] |
| 168 | [1–457]; [466–571] | [458–465]; [572–1023] |
| 169 | [1–54]; [57–501] | [55–56]; [502–1085] |
| 170 | [1–541] | [542–776] |
| 171 | [1–489] | [490–1219] |
| 172 | [1–538]; [977–1468] | [539–976]; [1469–1487] |
| 173 | [1–631] | [632–1915] |
| 174 | [21–776]; [888–967]; [969–1061]; [1063–1137]; [1819–1967] | [1–20]; [777–887]; [968–968]; [1062–1062]; [1138–1818]; [1968–1990] |
| 175 | [1–508] | [509–1971] |

TABLE Va-continued

| Seq Id No | Preferentially excluded fragments | Preferentially included fragments |
|---|---|---|
| 176 | [1–127]; [129–538]; [979–1470] | [128–128]; [539–978]; [1471–1613] |
| 177 | [1–535]; [973–1173]; [1177–1330]; [1332–1361] | [536–972]; [1174–1176]; [1331–1331] |
| 178 | [1–599]; [626–830]; [1082–1113] | [600–625]; [831–1081] |
| 179 | [1–623]; [1377–1406] | [624–1376]; [1407–1960] |
| 180 | [1–414]; [418–464] | [415–417]; [465–1443] |
| 181 | [1–522]; [533–587] | [523–532]; [588–605] |
| 182 | [1–78]; [99–131]; [136–327]; [1153–1184]; [1210–1274]; [1284–1319]; [1385–1416] | [79–98]; [132–135]; [328–1152]; [1185–1209]; [1275–1283]; [1320–1384]; [1417–1724] |
| 183 | [1–512]; [617–805]; [871–952]; [1387–1422]; [1621–1661] | [513–616]; [806–870]; [953–1386]; [1423–1620]; [1662–1686] |
| 184 | [1–453] | [454–463] |
| 185 | [1–773] | None |
| 186 | [1–413]; [423–604]; [606–739] | [414–422]; [605–605]; [740–753] |
| 187 | [1–117]; [119–401] | [118–118]; [402–754] |
| 188 | [1–511]; [684–870]; [872–928]; [935–981] | [512–683]; [871–871]; [929–934]; [982–998] |
| 189 | [1–605] | None |
| 190 | [2–475] | [1–1]; [476–526] |
| 191 | [1–910] | None |
| 192 | [1–101]; [103–668] | [102–102] |
| 193 | [1–520]; [583–637] | [521–582] |
| 194 | [1–706] | None |
| 195 | [1–145]; [150–451]; [466–670] | [146–149]; [452–465] |
| 196 | [1–509] | [510–510] |
| 197 | [1–500] | None |
| 198 | [1–503]; [505–585] | [504–504]; [586–667] |
| 199 | [1–498] | [499–514] |
| 200 | [1–462] | None |
| 201 | [1–551] | None |
| 202 | [1–482]; [484–550] | [483–483] |
| 203 | [1–408] | None |
| 204 | [1–519]; [521–649] | [520–520]; [650–665] |
| 205 | [1–261]; [263–415]; [417–640]; [642–782] | [262–262]; [416–416]; [641–641]; [783–1008] |
| 206 | [1–455] | None |
| 207 | [1–402]; [410–526] | [403–409]; [527–749] |
| 208 | [1–520] | [521–594] |
| 209 | [1–197]; [200–472] | [198–199]; [473–2098] |
| 210 | [1–311]; [314–427] | [312–313]; [428–428] |
| 211 | [1–689]; [735–769] | [690–734] |
| 212 | [1–517] | [518–914] |
| 213 | [2–576]; [756–795]; [1390–1441] | [1–1]; [577–755]; [796–1389]; [1442–1489] |
| 214 | [1–482] | [483–776] |
| 215 | [1–498] | [499–1412] |
| 216 | [1–505]; [1000–1293]; [1295–1408]; [1744–1773] | [506–999]; [1294–1294]; [1409–1743] |
| 217 | [1–102]; [104–291]; [293–467]; [486–708]; [723–831]; [833–900]; [910–1031]; [1054–1090]; [1097–1153] | [103–103]; [292–292]; [468–485]; [709–722]; [832–832]; [901–909]; [1032–1053]; [1091–1096]; [1154–1251] |
| 218 | [1–452] | [453–894] |
| 219 | [1–554]; [556–598] | [555–555]; [599–910] |
| 220 | [1–38]; [41–95]; [98–386]; [388–487] | [39–40]; [96–97]; [387–387]; [488–519] |
| 221 | [1–34]; [38–220]; [222–335]; [337–518] | [35–37]; [221–221]; [336–336]; [519–632] |
| 222 | [1–468] | [469–652] |
| 223 | [1–466] | [467–650] |
| 224 | [1–466] | [467–502] |
| 225 | [1–489]; [653–1008] | [490–652]; [1009–1739] |
| 226 | [1–657] | None |
| 227 | [1–480] | [481–888] |
| 228 | [1–501] | [502–716] |
| 229 | [1–612] | [613–654] |
| 230 | [1–477]; [485–538] | [478–484]; [539–635] |
| 231 | [1–476]; [484–537] | [477–483]; [538–634] |
| 232 | [1–367]; [371–512] | [368–370]; [513–583] |
| 233 | [1–305]; [307–442]; [460–503]; [553–646] | [306–306]; [443–459]; [504–552]; [647–753] |
| 234 | [1–260]; [262–345]; [347–454]; [473–515]; [565–658] | [261–261]; [346–346]; [455–472]; [516–564]; [659–762] |
| 235 | [1–427] | [428–537] |
| 236 | [1–465] | [466–994] |
| 237 | [1–471]; [496–526]; [557–587]; [597–637] | [472–495]; [527–556]; [588–596]; [638–662] |
| 238 | [1–338]; [352–497] | [339–351]; [498–1829] |
| 239 | [1–501] | [502–1083] |
| 240 | [1–515]; [1527–1583]; [1585–1687]; [1692–1831] | [516–1526]; [1584–1584]; [1688–1691] |
| 241 | [1–515]; [1526–1582]; [1584–1686]; [1691–1830] | [516–1525]; [1583–1583]; [1687–1690] |

TABLE Vb

| Seq Id No | Preferentially excluded fragments | Preferentially included fragments |
|---|---|---|
| 1 | [1–540]; [556–615]; [2061–2096]; [2098–2201] | [541–555]; [616–2060]; [2097–2097] |
| 2 | [1–511]; [533–619]; [621–690]; [730–1132] | [512–532]; [620–620]; [691–729]; [1133–1631] |
| 3 | [2–539]; [1178–1245] | [1–1]; [540–1177] |
| 4 | [1–250]; [297–383]; [386–514]; [1025–1064] | [251–296]; [384–385]; [515–1024]; [1065–1623] |
| 5 | [27–116]; [118–391] | [1–26]; [117–117]; [392–1454] |
| 6 | [1–93]; [96–168]; [170–262]; [264–461] | [94–95]; [169–169]; [263–263]; [462–1639] |
| 7 | [1–95]; [97–451] | [96–96]; [452–1768] |
| 8 | [1–502]; [1314–1491] | [503–1313]; [1492–1510] |
| 9 | [1–864] | [865–882] |
| 10 | [1–428] | [429–1849] |
| 11 | [1–454]; [482–514] | [455–481]; [515–565] |
| 12 | [1–375]; [379–511]; [533–690]; [730–783]; [814–1164] | [376–378]; [512–532]; [691–729]; [784–813]; [1165–1663] |
| 13 | [2–337]; [339–556] | [1–1]; [338–338]; [557–744] |
| 14 | [29–366]; [368–507] | [1–28]; [367–367]; [508–1759] |
| 15 | [29–366]; [368–524] | [1–28]; [367–367]; [525–1755] |
| 16 | [1–641] | [642–936] |
| 17 | [1–708]; [711–747] | [709–710] |
| 18 | [1–639] | [640–1884] |
| 19 | [1–631] | [632–691] |
| 20 | [3–416]; [418–490] | [1–2]; [417–417]; [491–1138] |
| 21 | [1–468] | None |
| 22 | [1–720] | None |
| 23 | [1–711] | [712–727] |
| 24 | [1–469] | [470–470] |
| 25 | [1–231]; [234–488] | [232–233]; [489–987] |
| 26 | [1–296]; [300–642]; [644–737] | [297–299]; [643–643]; [738–908] |
| 27 | [1–306]; [308–762] | [307–307] |
| 28 | [1–446]; [448–1102] | [447–447] |
| 29 | [1–436] | None |
| 30 | [7–334]; [1420–1468]; [1474–1614]; [1616–1804]; [1845–1919] | [1–6]; [335–1419]; [1469–1473]; [1615–1615]; [1805–1844]; [1920–1938] |
| 31 | [1–342]; [345–519]; [823–893]; [977–1016] | [343–344]; [520–822]; [894–976]; [1017–1116] |
| 32 | [1–517]; [821–891]; [975–1014] | [518–820]; [892–974]; [1015–1114] |
| 33 | [36–352]; [354–457]; [728–832]; [834–1096]; [1253–1289]; [1291–1350]; [1352–1412]; [1726–1873] | [1–35]; [353–353]; [458–727]; [833–833]; [1097–1252]; [1290–1290]; [1351–1351]; [1413–1725]; [1874–2072] |
| 34 | [1–409] | None |
| 35 | [14–105] | [1–13]; [106–836] |
| 36 | [1–572]; [1120–1271] | [573–1119]; [1272–1323] |
| 37 | [20–98]; [100–510]; [1591–1681]; [1683–1870] | [1–19]; [99–99]; [511–1590]; [1682–1682]; [1871–1945] |
| 38 | [1–547] | [548–1330] |
| 39 | [1–445] | [446–2124] |
| 40 | [1–473]; [475–528] | [474–474]; [529–1159] |
| 41 | [16–506]; [1587–1866] | [1–15]; [507–1586]; [1867–1953] |
| 42 | [2–234]; [244–451]; [974–1226] | [1–1]; [235–243]; [452–973]; [1227–1688] |
| 43 | [1–455]; [1670–1925] | [456–1669]; [1926–1942] |
| 44 | [1–579]; [815–1031] | [580–814]; [1032–1657] |
| 45 | [1–489]; [1012–1264] | [490–1011]; [1265–1733] |
| 46 | [1–400]; [1184–1223]; [1225–1705]; [1740–1818] | [401–1183]; [1224–1224]; [1706–1739]; [1819–1871] |
| 47 | [1–529]; [1326–1505] | [530–1325]; [1506–1523] |
| 48 | [1–131]; [133–510]; [560–589] | [132–132]; [511–559]; [590–832] |
| 49 | [1–130]; [132–509]; [559–588] | [131–131]; [510–558]; [589–831] |
| 50 | [1–650]; [652–868]; [873–913] | [651–651]; [869–872]; [914–917] |
| 51 | [1–504]; [515–605] | [505–514]; [606–621] |
| 52 | [1–535] | [536–673] |
| 53 | [2–563] | [1–1]; [564–897] |
| 54 | [1–527]; [802–870]; [882–934]; [966–1018]; [1037–1080] | [528–801]; [871–881]; [935–965]; [1019–1036]; [1081–1101] |
| 55 | [1–326]; [328–505] | [327–327]; [506–1047] |
| 56 | [1–340] | [341–925] |
| 57 | [1–528] | [529–1240] |
| 58 | [1–108]; [115–151]; [154–340]; [342–529] | [109–114]; [152–153]; [341–341]; [530–902] |
| 59 | [4–485]; [1566–1656]; [1658–1845] | [1–3]; [486–1565]; [1657–1657]; [1846–1969] |
| 60 | [1–283] | [284–1132] |
| 61 | [9–468] | [1–8]; [469–631] |
| 62 | [1–525]; [689–722] | [526–688] |
| 63 | [1–88]; [90–192]; [194–265]; [296–409] | [89–89]; [193–193]; [266–295]; [410–1442] |
| 64 | [1–517] | [518–795] |
| 65 | [1–406]; [408–739] | [407–407]; [740–1236] |
| 66 | [1–489]; [849–881] | [490–848] |
| 67 | [1–505] | [506–524] |
| 68 | [1–325]; [328–441]; [444–504] | [326–327]; [442–443]; [505–1472] |
| 69 | [1–524]; [636–715]; [717–809]; [811–885]; [1567–1715] | [525–635]; [716–716]; [810–810]; [886–1566]; [1716–1737] |

TABLE Vb-continued

| Seq Id No | Preferentially excluded fragments | Preferentially included fragments |
|---|---|---|
| 70 | [12–487] | [1–11]; [488–1637] |
| 71 | [12–487] | [1–11]; [488–1636] |
| 72 | [1–451] | [452–1758] |
| 73 | [1–167]; [242–464] | [168–241]; [465–1647] |
| 74 | [1–167]; [242–464] | [168–241]; [465–1646] |
| 75 | [1–471] | [472–1963] |
| 76 | [1–358]; [360–543]; [655–734]; [736–828]; [830–904]; [1586–1734] | [359–359]; [544–654]; [735–735]; [829–829]; [905–1585]; [1735–1757] |
| 77 | [3–34]; [36–474]; [582–770]; [1709–1746]; [1748–1785]; [1825–1899] | [1–2]; [35–35]; [475–581]; [771–1708]; [1747–1747]; [1786–1824]; [1900–2027] |
| 78 | [1–75]; [77–319]; [914–1052]; [1063–1126]; [1168–1203] | [76–76]; [320–913]; [1053–1062]; [1127–1167]; [1204–1880] |
| 79 | [1–425] | [426–584] |
| 80 | [1–752]; [947–1017]; [1084–1170] | [753–946]; [1018–1083]; [1171–1351] |
| 81 | [1–496]; [498–720] | [497–497] |
| 82 | [1–324] | [325–1029] |
| 83 | [1–477]; [1474–1529]; [1537–1566]; [1577–1616]; [1622–1662]; [1717–1753] | [478–1473]; [1530–1536]; [1567–1576]; [1617–1621]; [1663–1716]; [1754–1788] |
| 84 | [1–496]; [499–568]; [752–805] | [497–498]; [569–751] |
| 85 | [1–527] | [528–814] |
| 86 | [1–360] | [361–598] |
| 87 | [1–78]; [80–583]; [625–699] | [79–79]; [584–624] |
| 88 | [1–889] | [890–905] |
| 89 | [1–513] | [514–514] |
| 90 | [1–122]; [124–155]; [157–435]; [437–517] | [123–123]; [156–156]; [436–436]; [518–518] |
| 91 | [1–133]; [165–808] | [134–164] |
| 92 | [1–725] | [726–737] |
| 93 | [1–409] | [410–728] |
| 94 | [1–331] | [332–582] |
| 95 | [1–410] | [411–1913] |
| 96 | [1–501] | [502–670] |
| 97 | [1–141]; [143–431] | [142–142]; [432–939] |
| 98 | [1–193] | [194–661] |
| 99 | [1–629] | [630–647] |
| 100 | [1–520]; [862–954]; [976–1005] | [521–861]; [955–975]; [1006–1006] |
| 101 | [1–489]; [581–961]; [1010–1059] | [490–580]; [962–1009] |
| 102 | [1–485] | [486–514] |
| 103 | [1–540] | [541–1158] |
| 104 | [1–556] | [557–1563] |
| 105 | [1–868]; [870–1006] | [869–869]; [1007–1621] |
| 106 | [1–491] | [492–557] |
| 107 | [1–573] | [574–600] |
| 108 | [1–457]; [586–1110] | [458–585]; [1111–1129] |
| 109 | [1–521]; [655–778] | [522–654] |
| 110 | [1–416]; [478–614]; [616–990]; [992–1065]; [1068–1283] | [417–477]; [615–615]; [991–991]; [1066–1067]; [1284–1301] |
| 111 | [1–416]; [478–614]; [628–989]; [991–1064]; [1067–1282] | [417–477]; [615–627]; [990–990]; [1065–1066]; [1283–1300] |
| 112 | [2–429]; [1161–1202]; [1212–1388]; [1392–1589] | [1–1]; [430–1160]; [1203–1211]; [1389–1391]; [1590–1617] |
| 113 | [1–487] | [488–1634] |
| 114 | [1–70]; [86–496] | [71–85]; [497–693] |
| 115 | [1–358]; [360–558] | [359–359]; [559–784] |
| 116 | [1–215]; [218–495]; [527–607] | [216–217]; [496–526]; [608–804] |
| 117 | [1–466] | [467–484] |
| 118 | [1–515]; [906–963] | [516–905]; [964–985] |
| 119 | [1–744]; [746–816] | [745–745]; [817–839] |
| 120 | [1–85]; [87–521] | [86–86]; [522–583] |
| 121 | [1–532] | [533–1024] |
| 122 | [1–318]; [325–517]; [567–660] | [319–324]; [518–566]; [661–760] |
| 123 | [1–498] | [499–594] |
| 124 | [1–427] | [428–559] |
| 125 | [1–642] | [643–744] |
| 126 | [1–341]; [350–696] | [342–349]; [697–824] |
| 127 | [1–482] | [483–526] |
| 128 | [1–338] | [339–618] |
| 129 | [1–191]; [193–429]; [450–678] | [192–192]; [430–449]; [679–776] |
| 130 | [19–463]; [465–544] | [1–18]; [464–464]; [545–998] |
| 131 | [1–470] | [471–779] |
| 132 | [1–533] | [534–1025] |
| 133 | [1–498] | [499–607] |
| 134 | [1–168]; [170–326]; [328–471]; [552–738] | [169–169]; [327–327]; [472–551]; [739–774] |
| 135 | [1–346]; [348–395]; [440–473] | [347–347]; [396–439]; [474–611] |
| 136 | [1–324]; [343–436] | [325–342]; [437–925] |
| 137 | [1–186]; [188–251]; [255–517] | [187–187]; [252–254]; [518–674] |
| 138 | [1–488] | [489–1725] |
| 139 | [1–101]; [103–190]; [292–327]; [1091– | [102–102]; [191–291]; [328–1090]; [1162– |

TABLE Vb-continued

| Seq Id No | Preferentially excluded fragments | Preferentially included fragments |
|---|---|---|
|  | 1161]; [1228–1314] | 1227]; [1315–1474] |
| 140 | [1–465]; [516–653] | [466–515] |
| 141 | [1–761]; [763–857]; [912–1326] | [762–762]; [858–911]; [1327–1490] |
| 142 | [1–476] | [477–661] |
| 143 | [1–531]; [1471–1508]; [1510–1547]; [1587–1661] | [532–1470]; [1509–1509]; [1548–1586]; [1662–1789] |
| 144 | [1–492]; [503–536] | [493–502]; [537–2006] |
| 145 | [1–570] | [571–1096] |
| 146 | [1–536]; [621–703]; [729–1075]; [1198–1445] | [537–620]; [704–728]; [1076–1197]; [1446–1666] |
| 147 | [1–555]; [578–628] | [556–577]; [629–1687] |
| 148 | [1–444]; [1201–1474]; [1480–1516] | [445–1200]; [1475–1479]; [1517–1747] |
| 149 | [1–613]; [626–658] | [614–625] |
| 150 | [4–199]; [201–419]; [421–492] | [1–3]; [200–200]; [420–420]; [493–2045] |
| 151 | [1–509] | [510–788] |
| 152 | [1–483]; [485–578] | [484–484]; [579–1931] |
| 153 | [1–497] | [498–514] |
| 154 | [5–509]; [579–763]; [765–1162] | [1–4]; [510–578]; [764–764]; [1163–1183] |
| 155 | [1–486]; [1095–1500] | [487–1094]; [1501–1545] |
| 156 | [1–488]; [740–797]; [799–884]; [895–974] | [489–739]; [798–798]; [885–894]; [975–1068] |
| 157 | [1–161]; [163–565]; [567–701] | [162–162]; [566–566]; [702–1097] |
| 158 | [1–496]; [692–754] | [497–691]; [755–894] |
| 159 | [1–483] | [484–703] |
| 160 | [1–494] | [495–849] |
| 161 | [1–491] | [492–846] |
| 162 | [1–505]; [575–759]; [761–1164] | [506–574]; [760–760]; [1165–1176] |
| 163 | [1–699] | [700–1084] |
| 164 | [38–483]; [485–556] | [1–37]; [484–484]; [557–1793] |
| 165 | [1–426]; [1303–1444]; [1717–1755]; [1787–1825] | [427–1302]; [1445–1716]; [1756–1786]; [1826–1849] |
| 166 | [2–264]; [266–446]; [448–519] | 1–1]; [265–265]; [447–447]; [520–1748] |
| 167 | [1–519]; [523–552] | [520–522]; [553–1275] |
| 168 | [1–457]; [466–571] | [458–465]; [572–1023] |
| 169 | [1–54]; [57–501] | [55–56]; [502–1085] |
| 170 | [1–541] | [542–776] |
| 171 | [1–489] | [490–1219] |
| 172 | [1–538]; [977–1468] | [539–976]; [1469–1487] |
| 173 | [1–631] | [632–1915] |
| 174 | [21–776]; [888–967]; [969–1061]; [1063–1137]; [1819–1967] | [1–20]; [777–887]; [968–968]; [1062–1062]; [1138–1818]; [1968–1990] |
| 175 | [1–508] | [509–1971] |
| 176 | [1–127]; [129–538]; [979–1470] | [128–128]; [539–978]; [1471–1613] |
| 177 | [1–535]; [973–1173]; [1177–1330]; [1332–1361] | [536–972]; [1174–1176]; [1331–1331] |
| 178 | [1–599]; [626–830]; [1082–1113] | [600–625]; [831–1081] |
| 179 | [1–623]; [1377–1406] | [624–1376]; [1407–1960] |
| 180 | [1–414]; [418–464] | [415–417]; [465–1443] |
| 181 | [1–522]; [533–587] | [523–532]; [588–605] |
| 182 | [1–78]; [99–131]; [136–327]; [1153–1184]; [1210–1274]; [1284–1319]; [1385–1416] | [79–98]; [132–135]; [328–1152]; [1185–1209]; [1275–1283]; [1320–1384]; [1417–1724] |
| 183 | [1–512]; [617–805]; [871–952]; [1387–1422]; [1621–1661] | [513–616]; [806–870]; [953–1386]; [1423–1620]; [1662–1686] |
| 184 | [1–453] | [454–463] |
| 185 | [1–773] | None |
| 186 | [1–413]; [423–604]; [606–739] | [414–422]; [605–605]; [740–753] |
| 187 | [1–117]; [119–401] | [118–118]; [402–754] |
| 188 | [1–511]; [684–870]; [872–928]; [935–981] | [512–683]; [871–871]; [929–934]; [982–998] |
| 189 | [1–605] | None |
| 190 | [2–475] | [1–1]; [476–526] |
| 191 | [1–910] | None |
| 192 | [1–101]; [103–668] | [102–102] |
| 193 | [1–520]; [583–637] | [521–582] |
| 194 | [1–706] | None |
| 195 | [1–145]; [150–451]; [466–670] | [146–149]; [452–465] |
| 196 | [1–509] | [510–510] |
| 197 | [1–500] | None |
| 198 | [1–503]; [505–585] | [504–504]; [586–667] |
| 199 | [1–498] | [499–514] |
| 200 | [1–462] | None |
| 201 | [1–551] | None |
| 202 | [1–482]; [484–550] | [483–483] |
| 203 | [1–408] | None |
| 204 | [1–519]; [521–649] | [520–520]; [650–665] |
| 205 | [1–261]; [263–415]; [417–640]; [642–782] | [262–262]; [416–416]; [641–641]; [783–1008] |
| 206 | [1–455] | None |
| 207 | [1–402]; [410–526] | [403–409]; [527–749] |
| 208 | [1–520] | [521–594] |
| 209 | [1–197]; [200–472] | [198–199]; [473–2098] |
| 210 | [1–311]; [314–427] | [312–313]; [428–428] |

TABLE Vb-continued

| Seq Id No | Preferentially excluded fragments | Preferentially included fragments |
|---|---|---|
| 211 | [1–689]; [735–769] | [690–734] |
| 212 | [1–517] | [518–914] |
| 213 | [2–576]; [756–795]; [1390–1441] | [1–1]; [577–755]; [796–1389]; [1442–1489] |
| 214 | [1–482] | [483–776] |
| 215 | [1–498] | [499–1412] |
| 216 | [1–505]; [1000–1293]; [1295–1408]; [1744–1773] | [506–999]; [1294–1294]; [1409–1743] |
| 217 | [1–102]; [104–291]; [293–467]; [486–708]; [723–831]; [833–900]; [910–1031]; [1054–1090]; [1097–1153] | [103–103]; [292–292]; [468–485]; [709–722]; [832–832]; [901–909]; [1032–1053]; [1091–1096]; [1154–1251] |
| 218 | [1–452] | [453–894] |
| 219 | [1–554]; [556–598] | [555–555]; [599–910] |
| 220 | [1–38]; [41–95]; [98–386]; [388–487] | [39–40]; [96–97]; [387–387]; [488–519] |
| 221 | [1–34]; [38–220]; [222–335]; [337–518] | [35–37]; [221–221]; [336–336]; [519–632] |
| 222 | [1–468] | [469–652] |
| 223 | [1–466] | [467–650] |
| 224 | [1–466] | [467–502] |
| 225 | [1–489]; [653–1008] | [490–652]; [1009–1739] |
| 226 | [1–657] | None |
| 227 | [1–480] | [481–888] |
| 228 | [1–501] | [502–716] |
| 229 | [1–612] | [613–654] |
| 230 | [1–477]; [485–538] | [478–484]; [539–635] |
| 231 | [1–476]; [484–537] | [477–483]; [538–634] |
| 232 | [1–367]; [371–512] | [368–370]; [513–583] |
| 233 | [1–305]; [307–442]; [460–503]; [553–646] | [306–306]; [443–459]; [504–552]; [647–753] |
| 234 | [1–260]; [262–345]; [347–454]; [473–515]; [565–658] | [261–261]; [346–346]; [455–472]; [516–564]; [659–762] |
| 235 | [1–427] | [428–537] |
| 236 | [1–465] | [466–994] |
| 237 | [1–471]; [496–526]; [557–587]; [597–637] | [472–495]; [527–556]; [588–596]; [638–662] |
| 238 | [1–338]; [352–497] | [339–351]; [498–1829] |
| 239 | [1–501] | [502–1083] |
| 240 | [1–515]; [1527–1583]; [1585–1687]; [1692–1831] | [516–1526]; [1584–1584]; [1688–1691] |
| 241 | [1–515]; [1526–1582]; [1584–1686]; [1691–1830] | [516–1525]; [1583–1583]; [1687–1690] |

TABLE VI

| Seq Id No | Designation of domain | Database | Positions of domains |
|---|---|---|---|
| 242 | Cell attachment sequence | PROSITE | 141–143 |
| 242 | Peptidase family M20/M25/M40 | PFAM | 107–451 |
| 244 | Mitochondrial energy transfer proteins signature | PROSITE | 26–35 |
| 244 | Mitochondrial energy transfer proteins signature | PROSITE | 199–208 |
| 244 | Mitochondrial carrier proteins | PFAM | 5–84; 87–175; 178–272 |
| 244 | Mitochondrial energy transfer proteins. | BLOCKSPLUS | 12–36 |
| 244 | Mitochondrial energy transfer proteins. | BLOCKSPLUS | 13–36 |
| 244 | Mitochondrial energy transfer proteins. | BLOCKSPLUS | 131–144 |
| 245 | Leucine zipper pattern | PROSITE | 371–392 |
| 249 | Leucine zipper pattern | PROSITE | 20–41 |
| 251 | Mitochondrial energy transfer proteins signature | PROSITE | 26–35 |
| 251 | Mitochondrial carrier proteins | PFAM | 5–72 |
| 251 | Mitochondrial energy transfer proteins. | BLOCKSPLUS | 12–36 |
| 251 | Mitochondrial energy transfer proteins. | BLOCKSPLUS | 13–36 |
| 254 | Pancreatic ribonuclease family signature | PROSITE | 63–69 |
| 254 | Pancreatic ribonucleases | PFAM | 26–143 |
| 254 | PANCREATIC RIBONUCLEASE FAMILY SIGNATURE | BLOCKSPLUS | 49–69 |
| 254 | Pancreatic ribonuclease family proteins. | BLOCKSPLUS | 115–140 |
| 254 | PANCREATIC RIBONUCLEASE FAMILY SIGNATURE | BLOCKSPLUS | 92–110 |
| 254 | PANCREATIC RIBONUCLEASE FAMILY SIGNATURE | BLOCKSPLUS | 114–133 |
| 254 | Pancreatic ribonuclease family proteins. | BLOCKSPLUS | 30–40 |
| 254 | PANCREATIC RIBONUCLEASE FAMILY SIGNATURE | BLOCKSPLUS | 114–137 |
| 254 | PANCREATIC RIBONUCLEASE FAMILY | BLOCKSPLUS | 69–86 |

TABLE VI-continued

| Seq Id No | Designation of domain | Database | Positions of domains |
|---|---|---|---|
| | SIGNATURE | | |
| 255 | L-lactate dehydrogenase active site | PROSITE | 239–245 |
| 255 | lactate/malate dehydrogenase | PFAM | 71–380 |
| 255 | L-lactate dehydrogenase proteins. | BLOCKSPLUS | 186–224 |
| 255 | L-LACTATE DEHYDROGENASE SIGNATURE | BLOCKSPLUS | 96–121 |
| 255 | L-lactate dehydrogenase proteins. | BLOCKSPLUS | 71–102 |
| 255 | L-lactate dehydrogenase proteins. | BLOCKSPLUS | 238–256 |
| 255 | L-LACTATE DEHYDROGENASE SIGNATURE | BLOCKSPLUS | 183–203 |
| 255 | L-lactate dehydrogenase proteins. | BLOCKSPLUS | 288–323 |
| 255 | L-LACTATE DEHYDROGENASE SIGNATURE | BLOCKSPLUS | 207–224 |
| 255 | L-LACTATE DEHYDROGENASE SIGNATURE | BLOCKSPLUS | 71–92 |
| 255 | L-lactate dehydrogenase proteins. | BLOCKSPLUS | 138–167 |
| 256 | lactate/malate dehydrogenase | PFAM | 71–124 |
| 256 | L-LACTATE DEHYDROGENASE SIGNATURE | BLOCKSPLUS | 96–121 |
| 256 | L-lactate dehydrogenase proteins. | BLOCKSPLUS | 71–102 |
| 256 | L-LACTATE DEHYDROGENASE SIGNATURE | BLOCKSPLUS | 71–92 |
| 256 | L-lactate dehydrogenase proteins. | BLOCKSPLUS | 71–100 |
| 256 | L-LACTATE DEHYDROGENASE SIGNATURE | BLOCKSPLUS | 71–84 |
| 257 | Leucine zipper pattern | PROSITE | 155–176 |
| 259 | HORMA domain | PFAM | 22–230 |
| 261 | Leucine zipper pattern | PROSITE | 142–163 |
| 261 | Leucine zipper pattern | PROSITE | 170–191 |
| 263 | Leucine zipper pattern | PROSITE | 15–36 |
| 264 | Ubiquitin family | PFAM | 1–82 |
| 264 | Ubiquitin domain proteins. | BLOCKSPLUS | 17–62 |
| 264 | Ubiquitin domain proteins. | BLOCKSPLUS | 21–68 |
| 264 | Ubiquitin domain proteins. | BLOCKSPLUS | 26–68 |
| 264 | Ubiquitin domain proteins. | BLOCKSPLUS | 17–68 |
| 266 | u-PAR/Ly-6 domain | PFAM | 60–119 |
| 266 | Squash family of serine protease inhibit | PFAM | 32–47 |
| 267 | Zinc finger, C2H2 type, domain proteins. | BLOCKSPLUS | 185–202 |
| 271 | LBP/BPI/CETP family signature | PROSITE | 28–60 |
| 271 | Pyrokinins signature | PROSITE | 324–328 |
| 271 | LBP/BPI/CETP family | PFAM | 10–479 |
| 271 | LBP/BPI/CETP family proteins. | BLOCKSPLUS | 72–118 |
| 271 | LBP/BPI/CETP family proteins. | BLOCKSPLUS | 209–253 |
| 271 | LBP/BPI/CETP family proteins. | BLOCKSPLUS | 28–58 |
| 271 | LBP/BPI/CETP family proteins. | BLOCKSPLUS | 275–309 |
| 271 | LBP/BPI/CETP family proteins. | BLOCKSPLUS | 76–113 |
| 272 | Zinc finger, C3HC4 type (RING finger), signature | PROSITE | 102–111 |
| 272 | Zinc finger, C3HC4 type (RING finger) | PFAM | 87–129 |
| 272 | Zinc finger, C3HC4 type (RING finger), proteins. | BLOCKSPLUS | 102–111 |
| 273 | Zinc finger, C3HC4 type (RING finger), signature | PROSITE | 30–39 |
| 273 | Zinc finger, C3HC4 type (RING finger) | PFAM | 15–57 |
| 273 | Zinc finger, C3HC4 type (RING finger), proteins. | BLOCKSPLUS | 30–39 |
| 274 | RNA 3'-terminal phosphate cyclase signature | PROSITE | 157–167 |
| 274 | RNA 3'-terminal phosphate cyclase | PFAM | 1–368 |
| 274 | RNA 3'-terminal phosphate cyclase proteins. | BLOCKSPLUS | 12–44 |
| 274 | RNA 3'-terminal phosphate cyclase proteins. | BLOCKSPLUS | 157–168 |
| 275 | Ribosomal L27 protein | PFAM | 31–86 |
| 277 | Cell attachment sequence | PROSITE | 292–294 |
| 277 | DHHC zinc finger domain | PFAM | 140–204 |
| 279 | Endogenous opioids neuropeptides precursors signature | PROSITE | 26–65 |
| 279 | Vertebrate endogenous opioids neurope | PFAM | 3–257 |
| 279 | Endogenous opioids neuropeptides precursors proteins. | BLOCKSPLUS | 100–126 |
| 279 | Endogenous opioids neuropeptides precursors proteins. | BLOCKSPLUS | 209–237 |
| 279 | Endogenous opioids neuropeptides precursors proteins. | BLOCKSPLUS | 43–66 |
| 279 | Endogenous opioids neuropeptides precursors proteins. | BLOCKSPLUS | 18–38 |
| 279 | Endogenous opioids neuropeptides precursors proteins. | BLOCKSPLUS | 24–36 |

TABLE VI-continued

| Seq Id No | Designation of domain | Database | Positions of domains |
|---|---|---|---|
| 279 | Endogenous opioids neuropeptides precursors proteins. | BLOCKSPLUS | 105–125 |
| 280 | Leucine zipper pattern | PROSITE | 136–157 |
| 280 | Leucine zipper pattern | PROSITE | 272–293 |
| 283 | Immunoglobulins and major histocompatibility complex proteins signature | PROSITE | 380–386 |
| 283 | Immunoglobulin domain | PFAM | 205–285; 318–384 |
| 283 | Immunoglobulins and major histocompatibility complex proteins. | BLOCKSPLUS | 319–336 |
| 284 | Fucosyl transferase | PFAM | 70–406 |
| 285 | FAD/NAD-binding Cytochrome reductase | PFAM | 27–149 |
| 285 | Oxidoreductase FAD/NAD-binding domain | PFAM | 176–290 |
| 285 | Eukaryotic molybdopterin oxidoreductases proteins. | BLOCKSPLUS | 58–86 |
| 285 | CYTOCHROME B5 REDUCTASE SIGNATURE | BLOCKSPLUS | 75–86 |
| 285 | CYTOCHROME B5 REDUCTASE SIGNATURE | BLOCKSPLUS | 274–283 |
| 285 | CYTOCHROME B5 REDUCTASE SIGNATURE | BLOCKSPLUS | 141–156 |
| 285 | Eukaryotic molybdopterin oxidoreductases proteins. | BLOCKSPLUS | 274–286 |
| 285 | Eukaryotic molybdopterin oxidoreductases proteins. | BLOCKSPLUS | 60–85 |
| 285 | CYTOCHROME B5 REDUCTASE SIGNATURE | BLOCKSPLUS | 181–198 |
| 285 | FLAVOPROTEIN PYRIDINE NUCLEOTIDE CYTOCHROME REDUCTASE SIGNATURE | BLOCKSPLUS | 181–197 |
| 286 | Immunoglobulins and major histocompatibility complex proteins signature | PROSITE | 380–386 |
| 286 | Immunoglobulin domain | PFAM | 205–285; 318–384 |
| 286 | Immunoglobulins and major histocompatibility complex proteins. | BLOCKSPLUS | 319–336 |
| 287 | Leucine zipper pattern | PROSITE | 126–147 |
| 288 | Leucine zipper pattern | PROSITE | 20–41 |
| 291 | Tissue inhibitors of metalloproteinases signature | PROSITE | 24–36 |
| 291 | Tissue inhibitor of metalloproteinases | PFAM | 22–199 |
| 291 | Tissue inhibitors of metalloproteinases proteins. | BLOCKSPLUS | 21–46 |
| 291 | Tissue inhibitors of metalloproteinases proteins. | BLOCKSPLUS | 106–148 |
| 291 | Tissue inhibitors of metalloproteinases proteins. | BLOCKSPLUS | 81–95 |
| 291 | Tissue inhibitors of metalloproteinases proteins. | BLOCKSPLUS | 61–72 |
| 294 | Domain of unknown function DUF59 | PFAM | 31–135 |
| 296 | Immunoglobulin domain | PFAM | 141–197 |
| 297 | TonB-dependent receptor proteins signature 1 | PROSITE | 1–42 |
| 298 | Fibroblast growth factor | PFAM | 48–129 |
| 299 | BolA-like protein | PFAM | 39–114 |
| 299 | PROTEIN BOLA TRANSCRIPTION REGULATION AC. | BLOCKSPLUS | 68–98 |
| 301 | Cell attachment sequence | PROSITE | 172–174 |
| 303 | Ribosomal L27 protein | PFAM | 31–115 |
| 304 | Leucine rich repeat C-terminal domain | PFAM | 173–222 |
| 304 | Leucine Rich Repeat | PFAM | 92–115; 116–139; 140–163; 164–185 |
| 309 | Leucine rich repeat C-terminal domain | PFAM | 173–222 |
| 309 | Leucine Rich Repeat | PFAM | 92–115; 116–139; 140–163; 164–185 |
| 311 | NOL1/NOP2/sun family | PFAM | 201–276; 353–378 |
| 311 | NOL1/NOP2/sun family proteins. | BLOCKSPLUS | 230–245 |
| 311 | NOL1/NOP2/sun family proteins. | BLOCKSPLUS | 231–245 |
| 312 | NOL1/NOP2/sun family | PFAM | 201–276 |
| 312 | NOL1/NOP2/sun family proteins. | BLOCKSPLUS | 230–245 |
| 312 | NOL1/NOP2/sun family proteins. | BLOCKSPLUS | 231–245 |
| 314 | Leucine zipper pattern | PROSITE | 8–29 |
| 315 | Leucine zipper pattern | PROSITE | 8–29 |
| 341 | Immunoglobulin domain | PFAM | 45–112 |
| 349 | CDP-alcohol phosphatidyltransferases signature | PROSITE | 54–76 |
| 349 | Cytochrome b/b6 Qo site signature | PROSITE | 97–102 |
| 354 | SAM domain (Sterile alpha motif) | PFAM | 82–147 |
| 361 | Ribosomal Proteins L2 | PFAM | 96–124 |
| 368 | DAD family | PFAM | 1–78 |

TABLE VI-continued

| Seq Id No | Designation of domain | Database | Positions of domains |
|---|---|---|---|
| 370 | Ribosomal protein L34 | PFAM | 51–92 |
| 385 | Kelch motif | PFAM | 20–66; 68–114; 116–162; 164–209; 211–265; 270–316 |
| 386 | SPRY domain | PFAM | 85–205 |
| 388 | PHD-finger. | BLOCKSPLUS | 329–339 |
| 389 | Eukaryotic thiol (cysteine) proteases histidine active site | PROSITE | 268–278 |
| 389 | Heat shock hsp70 proteins family signature 3 | PROSITE | 332–346 |
| 389 | Hsp70 protein | PFAM | 3–509 |
| 390 | Eukaryotic-type carbonic anhydrase | PFAM | 20–59 |
| 391 | PMP–22/EMP/MP20/Claudin family | PFAM | 4–162 |
| 392 | Sec1 family. | BLOCKSPLUS | 89–107 |
| 393 | PMP–22/EMP/MIP20/Claudin family | PFAM | 4–182 |
| 394 | Myc-type, 'helix-loop-helix' dimerization domain signature | PROSITE | 13–28 |
| 395 | Glutathione S-transferases. | PFAM | 47–122; 260–309 |
| 396 | Transmembrane 4 family signature | PROSITE | 112–134 |
| 396 | Transmembrane 4 family | PFAM | 66–273 |
| 396 | Transmembrane 4 family proteins. | BLOCKSPLUS | 108–146 |
| 396 | TRANSMEMBRANE FOUR FAMILY SIGNATURE | BLOCKSPLUS | 129–151 |
| 396 | TRANSMEMBRANE FOUR FAMILY SIGNATURE | BLOCKSPLUS | 108–127 |
| 396 | TRANSMEMBRANE FOUR FAMILY SIGNATURE | BLOCKSPLUS | 247–274 |
| 396 | TRANSMEMBRANE FOUR FAMILY SIGNATURE | BLOCKSPLUS | 129–150 |
| 396 | TRANSMEMBRANE FOUR FAMILY SIGNATURE | BLOCKSPLUS | 128–154 |
| 397 | ATP/GTP-binding site motif A (P-loop) | PROSITE | 6–13 |
| 397 | ADP-ribosylation factor family | PFAM | 2–172 |
| 398 | Isochorismatase family | PFAM | 17–147 |
| 399 | PAP2 superfamily | PFAM | 19–175 |
| 400 | Zinc carboxypeptidases, zinc-binding region 2 signature | PROSITE | 117–127 |
| 401 | Zinc finger, C2H2 type, domain | PROSITE | 36–57 |
| 401 | Zinc finger, C2H2 type, domain | PROSITE | 73–93 |
| 401 | Zinc finger, C2H2 type, domain | PROSITE | 114–134 |
| 401 | Zinc finger, C2H2 type, domain | PROSITE | 145–165 |
| 401 | Zinc finger, C2H2 type | PFAM | 34–57; 71–93; 112–134; 143–165 |
| 401 | Zinc finger, C2H2 type, domain proteins. | BLOCKSPLUS | 145–162 |
| 401 | Zinc finger, C2H2 type, domain proteins. | BLOCKSPLUS | 114–131 |
| 401 | Zinc finger, C2H2 type, domain proteins. | BLOCKSPLUS | 73–90 |
| 402 | Zinc finger, C2H2 type, domain | PROSITE | 113–133 |
| 402 | Zinc finger, C2H2 type, domain | PROSITE | 144–164 |
| 402 | Regulator of chromosome condensation (RCC1) signature 2 | PROSITE | 65–75 |
| 402 | Zinc finger, C2H2 type | PFAM | 111–133; 142–164 |
| 402 | Zinc finger, C2H2 type, domain proteins. | BLOCKSPLUS | 144–161 |
| 402 | Zinc finger, C2H2 type, domain proteins. | BLOCKSPLUS | 113–130 |
| 403 | Glutathione S-transferases. | PFAM | 47–122; 260–309 |
| 405 | PMP-22/EMP/MP20/Claudin family | PFAM | 4–182 |
| 406 | WD domain, G-beta repeat | PFAM | 267–304; 333–370 |
| 408 | Rhomboid family | PFAM | 186–323 |
| 410 | Ank repeat | PFAM | 47–79 |
| 410 | REPEAT PROTEIN ANK NUCLEAR ANKYR. | BLOCKSPLUS | 78–89 |
| 410 | Ank repeat proteins. | BLOCKSPLUS | 48–56 |
| 412 | Serine proteases, subtilase family, aspartic acid proteins. | BLOCKSPLUS | 165–178 |
| 414 | Sir2 family | PFAM | 84–268 |
| 416 | Kelch motif | PFAM | 20–66; 68–114; 116–162; 164–209; 211–265; 270–316 |
| 418 | Zinc-binding dehydrogenases | PFAM | 16–313 |
| 426 | Leucine zipper pattern | PROSITE | 144–165 |
| 447 | Cytochrome c family heme-binding site | PROSITE | 19–24 |

TABLE VI-continued

| Seq Id No | Designation of domain | Database | Positions of domains |
|---|---|---|---|
| | signature | | |
| 447 | Immunoglobulins and major histocompatibility complex proteins signature | PROSITE | 17–23 |
| 453 | eIF-6 family | PFAM | 3–103 |
| 454 | Cell attachment sequence | PROSITE | 226–228 |
| 456 | Leucine zipper pattern | PROSITE | 211–232 |
| 457 | Leucine zipper pattern | PROSITE | 236–257 |
| 466 | Zinc finger, C3HC4 type (RING finger), signature | PROSITE | 56–65 |
| 466 | SPRY domain | PFAM | 375–500 |
| 466 | Zinc finger, C3HC4 type (RING finger) | PFAM | 41–81 |
| 466 | B-box zinc finger. | PFAM | 110–153 |
| 466 | Domain in SPla and the RYanodine Receptor. | BLOCKSPLUS | 359–381 |
| 466 | Domain in SPla and the RYanodine Receptor. | BLOCKSPLUS | 443–457 |
| 466 | Domain in SPla and the RYanodine Receptor. | BLOCKSPLUS | 359–380 |
| 466 | Zinc finger, C3HC4 type (RING finger), proteins. | BLOCKSPLUS | 56–65 |
| 479 | UBX domain | PFAM | 329–408 |
| 481 | TBC domain | PFAM | 65–171 |
| 481 | Probable rabGAP domain proteins. | BLOCKSPLUS | 153–159 |
| 482 | TBC domain | PFAM | 65–177 |
| 482 | Probable rabGAP domain proteins. | BLOCKSPLUS | 153–159 |

TABLE VII

| Seq Id No | Epitopes |
|---|---|
| 242 | 98 . . . 109; 119 . . . 127; 136 . . . 147; 156 . . . 170; 242 . . . 248; 255 . . . 265; 318 . . . 328; 356 . . . 363; 399 . . . 407; 443 . . . 450; 475 . . . 490 |
| 243 | 3 . . . 9; 59 . . . 65; 69 . . . 79; 113 . . . 126; 142 . . . 155; 193 . . . 198; 212 . . . 220; 231 . . . 245; 302 . . . 315 |
| 244 | 29 . . . 36; 33 . . . 42; 79 . . . 87; 139 . . . 147; 269 . . . 274 |
| 245 | 101 . . . 107; 141 . . . 151; 156 . . . 165; 196 . . . 207; 225 . . . 233; 242 . . . 251; 253 . . . 260; 284 . . . 298; 323 . . . 330; 339 . . . 347; 395 . . . 406 |
| 247 | 41 . . . 51; 108 . . . 120; 121 . . . 131; 190 . . . 200; 255 . . . 261; 302 . . . 307 |
| 248 | 5 . . . 11; 38 . . . 46; 52 . . . 60; 75 . . . 83; 92 . . . 99; 133 . . . 150; 167 . . . 183; 187 . . . 200; 210 . . . 219; 244 . . . 252; 270 . . . 286; 335 . . . 345; 354 . . . 371; 390 . . . 397 |
| 249 | 68 . . . 80; 91 . . . 99; 132 . . . 138; 185 . . . 193; 265 . . . 273; 276 . . . 293; 295 . . . 306; 305 . . . 329; 327 . . . 341; 347 . . . 358; 394 . . . 403 |
| 250 | 28 . . . 37; 60 . . . 67; 73 . . . 81 |
| 251 | 33 . . . 45; 64 . . . 71 |
| 252 | 20 . . . 30; 35 . . . 45; 49 . . . 59; 74 . . . 83 |
| 253 | 3 . . . 9; 59 . . . 65 |
| 254 | 22 . . . 33; 35 . . . 52; 53 . . . 67; 70 . . . 77; 80 . . . 100; 106 . . . 117; 142 . . . 147 |
| 255 | 116 . . . 123; 147 . . . 156; 201 . . . 208; 262 . . . 278 |
| 256 | 10 . . . 15; 116 . . . 121 |
| 257 | 41 . . . 51; 52 . . . 66; 72 . . . 80; 94 . . . 101; 120 . . . 127; 134 . . . 147; 180 . . . 193; 204 . . . 210; 227 . . . 240 |
| 258 | 147 . . . 157; 189 . . . 199 |
| 259 | 52 . . . 59; 66 . . . 76; 103 . . . 113; 115 . . . 127; 131 . . . 140; 143 . . . 148; 181 . . . 199; 242 . . . 250; 253 . . . 262; 262 . . . 273; 279 . . . 289; 330 . . . 341; 342 . . . 366; 373 . . . 394 |
| 260 | 94 . . . 107; 112 . . . 119; 125 . . . 134 |
| 261 | 121 . . . 126; 144 . . . 152; 213 . . . 224 |
| 263 | 44 . . . 50 |
| 264 | 51 . . . 58; 82 . . . 90; 153 . . . 164 |
| 266 | 15 . . . 20; 38 . . . 49; 76 . . . 81; 95 . . . 105 |
| 267 | 74 . . . 91; 94 . . . 99; 117 . . . 130; 140 . . . 154; 153 . . . 161; 175 . . . 184; 201 . . . 210; 228 . . . 240; 250 . . . 255 |
| 268 | 36 . . . 42; 43 . . . 54 |
| 269 | 41 . . . 46; 64 . . . 73; 80 . . . 100; 106 . . . 122; 160 . . . 172 |
| 270 | 38 . . . 48; 82 . . . 88 |
| 271 | 34 . . . 40; 72 . . . 79; 111 . . . 123; 146 . . . 153; 251 . . . 259; 307 . . . 314; 316 . . . 322; 372 . . . 377; 436 . . . 444 |
| 272 | 12 . . . 17; 51 . . . 58; 75 . . . 85; 128 . . . 136 |
| 273 | 4 . . . 13; 56 . . . 64 |
| 274 | 34 . . . 46; 120 . . . 127; 157 . . . 163; 182 . . . 191; 231 . . . 240; 259 . . . 267; 273 . . . 279; 291 . . . 299; 344 . . . 355 |
| 275 | 30 . . . 55; 72 . . . 78 |
| 276 | 27 . . . 35; 37 . . . 45; 49 . . . 61; 61 . . . 77; 102 . . . 109; 144 . . . 152; 170 . . . 180; 179 . . . 188 |
| 277 | 61 . . . 67; 147 . . . 152; 154 . . . 166; 284 . . . 299; 308 . . . 313 |
| 278 | 72 . . . 82; 451 . . . 461; 532 . . . 541 |
| 279 | 24 . . . 31; 72 . . . 84; 83 . . . 92; 97 . . . 111; 144 . . . 149; 161 . . . 182; 181 . . . 189; |

TABLE VII-continued

| Seq Id No | Epitopes |
|---|---|
| | 192 . . . 198; 204 . . . 214; 216 . . . 233; 241 . . . 254; 256 . . . 263 |
| 280 | 15 . . . 20; 50 . . . 56; 61 . . . 66; 204 . . . 212; 251 . . . 260; 354 . . . 362 |
| 281 | 24 . . . 38; 44 . . . 52 |
| 282 | 72 . . . 82; 451 . . . 461; 532 . . . 541 |
| 283 | 1 . . . 6; 21 . . . 31; 77 . . . 83; 115 . . . 120; 228 . . . 237; 276 . . . 281; 335 . . . 343; 401 . . . 407; 440 . . . 456; 456 . . . 468 |
| 284 | 4 . . . 9; 39 . . . 47; 50 . . . 66; 78 . . . 94; 111 . . . 122; 132 . . . 141; 169 . . . 174; 190 . . . 202; 213 . . . 220; 243 . . . 252; 261 . . . 274; 282 . . . 300; 369 . . . 376; 379 . . . 389; 395 . . . 403 |
| 285 | 29 . . . 38; 42 . . . 47; 58 . . . 65; 100 . . . 110; 121 . . . 134; 156 . . . 161; 161 . . . 173; 201 . . . 207; 230 . . . 239; 243 . . . 254; 290 . . . 302 |
| 286 | 1 . . . 6; 21 . . . 28; 77 . . . 83; 115 . . . 120; 228 . . . 237; 276 . . . 281; 335 . . . 343; 401 . . . 407 |
| 287 | 2 . . . 10; 94 . . . 104; 248 . . . 258; 268 . . . 286 |
| 288 | 68 . . . 80; 91 . . . 99; 132 . . . 138; 185 . . . 194; 262 . . . 270; 273 . . . 288; 291 . . . 301; 300 . . . 324; 322 . . . 336; 342 . . . 353; 389 . . . 398 |
| 289 | 23 . . . 38 |
| 291 | 28 . . . 35; 96 . . . 104; 134 . . . 144; 159 . . . 167; 177 . . . 187; 191 . . . 198 |
| 292 | 1 . . . 7; 56 . . . 64; 66 . . . 73; 77 . . . 92 |
| 293 | 40 . . . 45; 99 . . . 109 |
| 294 | 47 . . . 57; 120 . . . 126 |
| 295 | 31 . . . 61; 76 . . . 82; 143 . . . 149; 156 . . . 169 |
| 296 | 133 . . . 143; 151 . . . 156; 161 . . . 167; 169 . . . 181; 185 . . . 194 |
| 297 | 50 . . . 58; 59 . . . 69; 113 . . . 123; 120 . . . 137 |
| 298 | 45 . . . 55; 52 . . . 63; 106 . . . 117; 118 . . . 128; 126 . . . 131; 148 . . . 155; 157 . . . 164; 172 . . . 190; 212 . . . 221; 232 . . . 247 |
| 299 | 51 . . . 59; 82 . . . 87; 113 . . . 125; 124 . . . 135 |
| 300 | 72 . . . 82; 451 . . . 461; 532 . . . 541 |
| 301 | 43 . . . 52; 88 . . . 105; 192 . . . 211; 255 . . . 271 |
| 302 | 3 . . . 18; 37 . . . 44; 57 . . . 65; 70 . . . 76; 98 . . . 113; 121 . . . 134 |
| 303 | 30 . . . 55; 72 . . . 77; 82 . . . 88; 106 . . . 113 |
| 304 | 2 . . . 11; 33 . . . 42; 48 . . . 54; 55 . . . 63; 122 . . . 131; 147 . . . 154; 168 . . . 180; 200 . . . 209; 211 . . . 220; 226 . . . 233; 268 . . . 278; 286 . . . 291 |
| 305 | 22 . . . 31 |
| 306 | 5 . . . 11; 25 . . . 35; 72 . . . 81; 124 . . . 134; 147 . . . 157; 163 . . . 178; 177 . . . 186; 185 . . . 195; 207 . . . 217 |
| 307 | 23 . . . 38 |
| 308 | 66 . . . 72; 84 . . . 100 |
| 309 | 2 . . . 11; 33 . . . 42; 48 . . . 54; 55 . . . 63; 122 . . . 131; 147 . . . 154; 168 . . . 180; 200 . . . 209; 211 . . . 220; 226 . . . 233; 268 . . . 278; 286 . . . 291 |
| 310 | 45 . . . 52; 60 . . . 68; 88 . . . 94; 99 . . . 109; 113 . . . 120; 121 . . . 134; 162 . . . 171; 169 . . . 184; 194 . . . 202; 209 . . . 215; 223 . . . 235; 239 . . . 248; 273 . . . 281; 292 . . . 301; 319 . . . 329; 336 . . . 341; 389 . . . 394; 398 . . . 405; 421 . . . 426 |
| 311 | 15 . . . 21; 28 . . . 35; 82 . . . 91; 113 . . . 120; 125 . . . 133; 153 . . . 167; 236 . . . 243; 291 . . . 298; 307 . . . 312; 316 . . . 327; 390 . . . 396; 406 . . . 413; 436 . . . 457 |
| 312 | 15 . . . 21; 28 . . . 35; 82 . . . 91; 113 . . . 120; 125 . . . 133; 153 . . . 167; 236 . . . 243; 291 . . . 298; 307 . . . 312; 316 . . . 327; 352 . . . 370; 370 . . . 382 |
| 313 | 38 . . . 46; 52 . . . 60; 75 . . . 83; 92 . . . 99; 133 . . . 150; 167 . . . 183; 187 . . . 200; 210 . . . 219; 239 . . . 256 |
| 314 | 36 . . . 42; 52 . . . 58; 65 . . . 70; 80 . . . 87; 143 . . . 155; 161 . . . 168; 176 . . . 185; 203 . . . 208; 263 . . . 272 |
| 315 | 36 . . . 42; 52 . . . 58; 65 . . . 70; 80 . . . 87; 143 . . . 155; 161 . . . 168 |
| 316 | 33 . . . 47; 49 . . . 58; 106 . . . 117; 125 . . . 132 |
| 317 | 45 . . . 53; 54 . . . 68; 88 . . . 94; 99 . . . 109; 113 . . . 120; 121 . . . 134; 162 . . . 171; 169 . . . 184; 194 . . . 202; 209 . . . 215; 223 . . . 235; 239 . . . 248; 273 . . . 281; 292 . . . 301; 319 . . . 329; 336 . . . 341; 389 . . . 394; 398 . . . 405; 421 . . . 426 |
| 318 | 42 . . . 54; 69 . . . 77; 124 . . . 130; 148 . . . 153; 156 . . . 165; 186 . . . 210; 219 . . . 227; 271 . . . 286; 293 . . . 300 |
| 319 | 15 . . . 21; 25 . . . 37; 36 . . . 59; 58 . . . 64; 80 . . . 89; 86 . . . 102; 105 . . . 119 |
| 320 | 1 . . . 6; 81 . . . 89 |
| 321 | 111 . . . 116 |
| 322 | 1 . . . 21; 50 . . . 68; 76 . . . 85 |
| 323 | 11 . . . 16; 49 . . . 68 |
| 325 | 14 . . . 20; 40 . . . 55; 69 . . . 76; 122 . . . 131; 128 . . . 138; 158 . . . 166 |
| 326 | 18 . . . 45; 61 . . . 68; 81 . . . 89; 110 . . . 141; 142 . . . 149 |
| 327 | 43 . . . 48; 53 . . . 62; 85 . . . 95 |
| 328 | 4 . . . 9; 34 . . . 46 |
| 329 | 1 . . . 7; 58 . . . 69 |
| 330 | 34 . . . 42; 46 . . . 52; 56 . . . 66 |
| 331 | 59 . . . 69; 72 . . . 80; 80 . . . 89; 90 . . . 98; 110 . . . 115 |
| 332 | 14 . . . 24; 50 . . . 56 |
| 333 | 1 . . . 6; 41 . . . 47; 86 . . . 96; 120 . . . 134 |
| 334 | 17 . . . 23; 41 . . . 47; 50 . . . 57; 85 . . . 90; 96 . . . 105; 154 . . . 159; 181 . . . 192; 192 . . . 198 |
| 335 | 4 . . . 9; 21 . . . 28 |
| 336 | 49 . . . 65; 70 . . . 80 |
| 337 | 20 . . . 30; 36 . . . 42; 53 . . . 61; 74 . . . 83; 110 . . . 119; 125 . . . 138; 137 . . . 142 |
| 338 | 21 . . . 55; 55 . . . 65; 62 . . . 81; 88 . . . 100; 99 . . . 107 |
| 339 | 33 . . . 47; 52 . . . 60; 73 . . . 82 |
| 340 | 5 . . . 12; 13 . . . 21; 32 . . . 51; 65 . . . 72 |

TABLE VII-continued

| Seq Id No | Epitopes |
|---|---|
| 341 | 19 . . . 30; 44 . . . 52; 51 . . . 61; 68 . . . 82; 96 . . . 108 |
| 342 | 18 . . . 26; 44 . . . 54; 71 . . . 77 |
| 343 | 21 . . . 33; 57 . . . 66; 68 . . . 77; 80 . . . 89; 91 . . . 98 |
| 344 | 36 . . . 44; 89 . . . 95; 110 . . . 116; 181 . . . 193 |
| 345 | 19 . . . 28; 34 . . . 41; 43 . . . 55; 80 . . . 86; 119 . . . 124; 159 . . . 165; 167 . . . 176 |
| 346 | 26 . . . 35; 39 . . . 49; 88 . . . 95; 136 . . . 145; 207 . . . 217 |
| 347 | 2 . . . 10; 26 . . . 32; 52 . . . 68; 75 . . . 86 |
| 348 | 71 . . . 77; 82 . . . 89; 114 . . . 125 |
| 349 | 54 . . . 66; 70 . . . 76; 294 . . . 302 |
| 350 | 16 . . . 25; 31 . . . 37; 69 . . . 80 |
| 351 | 68 . . . 73; 118 . . . 129; 135 . . . 148 |
| 352 | 68 . . . 73; 118 . . . 129; 135 . . . 148 |
| 353 | 10 . . . 18; 61 . . . 69; 68 . . . 77 |
| 354 | 13 . . . 20; 44 . . . 51; 57 . . . 85; 94 . . . 102; 143 . . . 151 |
| 355 | 18 . . . 30; 38 . . . 43; 43 . . . 54 |
| 356 | 1 . . . 6; 40 . . . 45; 120 . . . 126; 129 . . . 154; 153 . . . 162 |
| 357 | 49 . . . 59; 133 . . . 141; 152 . . . 167 |
| 358 | 9 . . . 26; 80 . . . 85; 96 . . . 102 |
| 359 | 98 . . . 104; 181 . . . 187 |
| 360 | 1 . . . 6; 44 . . . 54; 113 . . . 123; 147 . . . 161 |
| 361 | 64 . . . 74; 77 . . . 90; 112 . . . 141 |
| 362 | 20 . . . 30; 37 . . . 42; 53 . . . 61; 74 . . . 83; 110 . . . 119; 125 . . . 134; 138 . . . 147 |
| 363 | 1 . . . 11; 26 . . . 31; 53 . . . 60; 97 . . . 105; 110 . . . 117; 141 . . . 146 |
| 364 | 16 . . . 24 |
| 365 | 7 . . . 15 |
| 367 | 8 . . . 14 |
| 368 | 16 . . . 23 |
| 369 | 5 . . . 14; 59 . . . 71; 74 . . . 83 |
| 370 | 39 . . . 45; 45 . . . 67; 82 . . . 91 |
| 371 | 37 . . . 46; 81 . . . 86; 92 . . . 99; 140 . . . 156; 163 . . . 169; 179 . . . 184; 209 . . . 216; 242 . . . 252; 258 . . . 268 |
| 372 | 72 . . . 81; 93 . . . 104; 141 . . . 146 |
| 373 | 71 . . . 77; 86 . . . 93 |
| 374 | 1 . . . 7; 31 . . . 47; 47 . . . 57; 59 . . . 65 |
| 375 | 5 . . . 10; 55 . . . 60; 83 . . . 90 |
| 376 | 34 . . . 43; 40 . . . 46; 67 . . . 81 |
| 377 | 27 . . . 38; 49 . . . 56; 54 . . . 64; 68 . . . 78; 111 . . . 122 |
| 378 | 9 . . . 26; 80 . . . 85; 96 . . . 102 |
| 379 | 41 . . . 50; 52 . . . 58; 195 . . . 204; 318 . . . 327; 337 . . . 347 |
| 380 | 98 . . . 103 |
| 381 | 46 . . . 51 |
| 382 | 67 . . . 22 |
| 383 | 4 . . . 12; 25 . . . 33; 73 . . . 81 |
| 384 | 42 . . . 54; 69 . . . 77; 117 . . . 127; 125 . . . 141 |
| 385 | 105 . . . 112; 146 . . . 155; 181 . . . 187; 200 . . . 214; 230 . . . 243; 254 . . . 264; 261 . . . 272 290 . . . 295 |
| 386 | 46 . . . 53; 92 . . . 100; 107 . . . 114; 116 . . . 123; 126 . . . 132; 176 . . . 182 |
| 387 | 5 . . . 12; 44 . . . 50; 158 . . . 167; 190 . . . 195 |
| 388 | 16 . . . 25; 31 . . . 37; 73 . . . 79; 96 . . . 101; 105 . . . 110; 158 . . . 166; 215 . . . 224; 240 . . . 247; 273 . . . 280; 299 . . . 306; 321 . . . 334; 347 . . . 352; 370 . . . 375 |
| 389 | 28 . . . 35; 72 . . . 81; 93 . . . 100; 101 . . . 113; 183 . . . 192; 218 . . . 228; 284 . . . 300; 318 . . . 330; 339 . . . 344; 443 . . . 454; 481 . . . 489; 491 . . . 500 |
| 390 | 1 . . . 8; 39 . . . 48 |
| 391 | 104 . . . 114; 157 . . . 162 |
| 392 | 28 . . . 34; 31 . . . 36; 46 . . . 55; 77 . . . 85 |
| 393 | 104 . . . 114; 188 . . . 224 |
| 394 | 44 . . . 51; 107 . . . 114 |
| 395 | 2 . . . 15; 51 . . . 61; 82 . . . 88; 104 . . . 114; 249 . . . 259; 286 . . . 298; 333 . . . 340; 361 . . . 367 |
| 396 | 24 . . . 31; 54 . . . 65; 79 . . . 85; 92 . . . 99; 180 . . . 186; 216 . . . 221 |
| 397 | 20 . . . 33; 31 . . . 41; 67 . . . 75; 82 . . . 89; 168 . . . 173 |
| 398 | 58 . . . 65; 93 . . . 101; 135 . . . 143; 198 . . . 203 |
| 399 | 11 . . . 17; 37 . . . 48; 71 . . . 79; 94 . . . 100; 99 . . . 112; 132 . . . 144; 161 . . . 173; 173 . . . 180 |
| 400 | 21 . . . 31; 65 . . . 84; 91 . . . 99 |
| 401 | 1 . . . 9; 11 . . . 27; 78 . . . 83; 88 . . . 96; 107 . . . 112; 112 . . . 121; 135 . . . 141; 147 . . . 153; 164 . . . 170 |
| 402 | 1 . . . 9; 11 . . . 35; 83 . . . 94; 106 . . . 111; 111 . . . 120; 134 . . . 140; 146 . . . 152; 163 . . . 169 |
| 403 | 2 . . . 15; 51 . . . 61; 82 . . . 88; 104 . . . 114; 249 . . . 259; 286 . . . 298; 333 . . . 340; 361 . . . 367 |
| 405 | 104 . . . 114; 188 . . . 224 |
| 406 | 1 . . . 7; 61 . . . 71; 77 . . . 83; 80 . . . 85; 163 . . . 179; 204 . . . 211; 210 . . . 225; 231 . . . 238; 254 . . . 259; 272 . . . 278; 305 . . . 321; 347 . . . 356 |
| 408 | 53 . . . 77; 120 . . . 130; 144 . . . 159; 159 . . . 169; 196 . . . 202; 266 . . . 272; 331 . . . 345 |
| 409 | 1 . . . 9; 73 . . . 81; 226 . . . 236 |
| 410 | 12 . . . 21; 37 . . . 49; 78 . . . 85 |
| 411 | 22 . . . 36; 151 . . . 156; 161 . . . 170 |
| 412 | 56 . . . 65; 136 . . . 146; 179 . . . 186; 192 . . . 207; 227 . . . 236 |
| 413 | 8 . . . 14; 92 . . . 99; 184 . . . 191 |
| 414 | 1 . . . 10; 16 . . . 30; 71 . . . 77; 95 . . . 105; 102 . . . 113; 123 . . . 130; 137 . . . 145; 165 . . . 171 |

TABLE VII-continued

| Seq Id No | Epitopes |
|---|---|
| | 199 . . . 205; 217 . . . 226; 286 . . . 295; 309 . . . 314; 360 . . . 376; 384 . . . 389 |
| 415 | 19 . . . 34; 100 . . . 107; 115 . . . 123; 143 . . . 149; 154 . . . 164; 168 . . . 175; 176 . . . 189 217 . . . 226; 224 . . . 239; 249 . . . 257; 264 . . . 270; 278 . . . 290; 294 . . . 303; 328 . . . 336; 347 . . . 356; 374 . . . 384; 391 . . . 396; 444 . . . 449; 453 . . . 460; 476 . . . 481 |
| 416 | 105 . . . 112; 147 . . . 155; 181 . . . 187; 200 . . . 214; 230 . . . 243; 254 . . . 264; 261 . . . 272; 290 . . . 295 |
| 417 | 8 . . . 14 |
| 418 | 8 . . . 14; 92 . . . 99; 227 . . . 236; 260 . . . 273; 293 . . . 300 |
| 419 | 8 . . . 16; 117 . . . 122 |
| 420 | 27 . . . 35; 71 . . . 83; 91 . . . 97; 137 . . . 146 |
| 421 | 2 . . . 11; 77 . . . 82 |
| 422 | 20 . . . 26; 61 . . . 69 |
| 423 | 9 . . . 19; 25 . . . 34; 47 . . . 60; 57 . . . 65; 87 . . . 92; 106 . . . 116; 126 . . . 134 |
| 424 | 6 . . . 18; 21 . . . 34; 53 . . . 62; 79 . . . 86; 89 . . . 95; 108 . . . 113; 128 . . . 149 |
| 425 | 2 . . . 11; 29 . . . 46; 47 . . . 55 |
| 426 | 5 . . . 26; 33 . . . 68 |
| 427 | 1 . . . 11; 19 . . . 38; 38 . . . 49; 52 . . . 60; 90 . . . 98; 100 . . . 105; 129 . . . 137; 155 . . . 160 |
| 428 | 23 . . . 31; 47 . . . 61; 65 . . . 72; 87 . . . 94 |
| 429 | 3 . . . 12; 31 . . . 39; 59 . . . 69; 82 . . . 87 |
| 430 | 81 . . . 91 |
| 431 | 36 . . . 44; 83 . . . 89 |
| 432 | 28 . . . 42; 56 . . . 76; 110 . . . 117 |
| 433 | 5 . . . 14; 43 . . . 49 |
| 434 | 9 . . . 17; 15 . . . 21; 61 . . . 70; 80 . . . 89 |
| 435 | 1 . . . 24; 32 . . . 40; 52 . . . 60 |
| 436 | 1 . . . 11; 17 . . . 30; 29 . . . 43 |
| 437 | 20 . . . 30; 28 . . . 35; 40 . . . 50 |
| 438 | 10 . . . 28; 76 . . . 85; 91 . . . 99; 107 . . . 112 |
| 439 | 86 . . . 92; 104 . . . 110 |
| 440 | 36 . . . 42; 47 . . . 57; 63 . . . 71; 106 . . . 121 |
| 441 | 19 . . . 25; 27 . . . 44 |
| 442 | 1 . . . 14; 21 . . . 29; 36 . . . 42; 44 . . . 51; 62 . . . 81; 101 . . . 109; 111 . . . 119; 138 . . . 149 |
| 443 | 10 . . . 18; 25 . . . 31; 33 . . . 40; 51 . . . 70; 89 . . . 94 |
| 444 | 3 . . . 8; 19 . . . 26; 32 . . . 44 |
| 445 | 1 . . . 11; 19 . . . 38; 38 . . . 49; 52 . . . 60; 130 . . . 139 |
| 446 | 12 . . . 20; 28 . . . 37; 43 . . . 66; 90 . . . 102 |
| 447 | 15 . . . 20; 24 . . . 31; 36 . . . 47; 68 . . . 82; 88 . . . 96 |
| 448 | 29 . . . 45; 83 . . . 91; 88 . . . 94; 132 . . . 144 |
| 449 | 22 . . . 33; 54 . . . 64; 86 . . . 96; 102 . . . 108 |
| 450 | 27 . . . 39; 47 . . . 60; 101 . . . 107; 155 . . . 164; 270 . . . 281; 287 . . . 300; 306 . . . 312; 327 . . . 332 |
| 451 | 13 . . . 24; 60 . . . 70; 77 . . . 83 |
| 452 | 8 . . . 14; 74 . . . 82 |
| 453 | 6 . . . 12; 63 . . . 78; 77 . . . 91; 97 . . . 103; 102 . . . 108 |
| 454 | 32 . . . 44; 66 . . . 72; 101 . . . 114; 166 . . . 174; 209 . . . 235; 243 . . . 252; 258 . . . 263 |
| 455 | 69 . . . 76; 131 . . . 139; 164 . . . 173 |
| 456 | 54 . . . 63; 95 . . . 103; 187 . . . 202; 211 . . . 216; 249 . . . 261 |
| 457 | 14 . . . 21; 31 . . . 45; 80 . . . 88; 187 . . . 194; 347 . . . 353 |
| 458 | 47 . . . 62; 79 . . . 86 |
| 459 | 1 . . . 8; 27 . . . 37; 90 . . . 97; 99 . . . 106; 123 . . . 140; 145 . . . 163 |
| 460 | 8 . . . 17; 35 . . . 45; 131 . . . 139; 162 . . . 169; 175 . . . 180 |
| 461 | 1 . . . 6; 13 . . . 23; 58 . . . 66; 89 . . . 101 |
| 462 | 44 . . . 53; 86 . . . 93 |
| 463 | 62 . . . 70 |
| 464 | 50 . . . 57; 59 . . . 69; 67 . . . 73; 79 . . . 95 |
| 465 | 10 . . . 17; 23 . . . 44 |
| 466 | 3 . . . 15; 71 . . . 78; 110 . . . 121; 125 . . . 131; 259 . . . 269; 296 . . . 306; 312 . . . 318; 340 . . . 346; 353 . . . 363; 370 . . . 379; 407 . . . 412; 417 . . . 425; 448 . . . 453; 483 . . . 493 |
| 467 | 5 . . . 12; 20 . . . 30; 70 . . . 78; 82 . . . 100; 106 . . . 115; 129 . . . 135 |
| 468 | 8 . . . 16; 22 . . . 31; 36 . . . 45; 75 . . . 84 |
| 469 | 14 . . . 23; 98 . . . 105; 106 . . . 116 |
| 470 | 11 . . . 23; 26 . . . 31; 54 . . . 62; 101 . . . 107 |
| 471 | 23 . . . 29; 66 . . . 81 |
| 472 | 23 . . . 29; 93 . . . 100 |
| 473 | 8 . . . 25; 79 . . . 89; 103 . . . 109 |
| 474 | 37 . . . 45; 80 . . . 89; 94 . . . 101; 125 . . . 130 |
| 475 | 37 . . . 45; 80 . . . 89; 94 . . . 101; 125 . . . 130 |
| 476 | 7 . . . 26; 23 . . . 36; 36 . . . 45; 78 . . . 83; 80 . . . 85 |
| 477 | 45 . . . 53 |
| 478 | 1 . . . 7; 16 . . . 22; 78 . . . 93; 96 . . . 102 |
| 479 | 24 . . . 33; 41 . . . 50; 61 . . . 80; 93 . . . 100; 129 . . . 136; 160 . . . 170; 199 . . . 208; 267 . . . 276; 325 . . . 335 |
| 480 | 5 . . . 14; 43 . . . 51; 102 . . . 116 |
| 481 | 2 . . . 15; 16 . . . 24; 53 . . . 62; 87 . . . 97; 100 . . . 109; 109 . . . 133; 145 . . . 152 |
| 482 | 2 . . . 15; 16 . . . 24; 53 . . . 62; 87 . . . 97; 100 . . . 109; 109 . . . 133; 145 . . . 152; 168 . . . 176 |

TABLE VIII

| Seq Id No | Chromosomal location |
|---|---|
| 2 | 16p11–p13 |
| 12 | 16p11–p13 |
| 22 | 7q35–q36 |
| 25 | chr.19 |
| 34 | chr.17 |
| 35 | 6p21.3 |
| 40 | chr.20 |
| 42 | 12p13.3 |
| 45 | 12p13.3 |
| 51 | 12p |
| 56 | 22q11.2–q13.2 |
| 57 | 12p13 |
| 60 | chr.10 |
| 62 | chr.17 |
| 65 | Xq13 |
| 67 | chr.14 |
| 70 | chr.7(1); 7q11.23–q21.1(1) |
| 71 | chr.7(1); 7q11.23–q21.1(1) |
| 73 | 6p21.3 |
| 74 | 6p21.3 |
| 87 | 19q13.1 |
| 88 | 7q21–q22 |
| 94 | 17q11.2 |
| 99 | 6q21 |
| 101 | 6p11.2–p21.3 |
| 103 | chr.17 |
| 106 | 6q15–q16.3 |
| 107 | 16p13.3 |
| 108 | 12q |
| 113 | 1p33–p34.3 |
| 125 | 6p22.1–p22.3 |
| 126 | 16p13.3 |
| 127 | 14q11.2 |
| 135 | 22q11.2–q13.2 |
| 138 | chr.3 |
| 141 | 12q24.1 |
| 146 | 3p21.3 |
| 147 | chr.2 |
| 149 | chr.17 |
| 150 | 21q |
| 152 | 21q |
| 154 | 20q12–q13.11 |
| 155 | 11p15.5 |
| 160 | 19q13.2 |
| 161 | 19q13.2 |
| 162 | 20q12–q13.11 |
| 164 | 21q |
| 166 | 21q |
| 170 | 6p12.1–p21.1 |
| 172 | 21q |
| 173 | chr.19 |
| 176 | 21q |
| 177 | 21q |
| 179 | chr.6 |
| 183 | chr.7 |
| 185 | Xq21.3–q22.3 |
| 186 | chr.20 |
| 192 | 11q12.2 |
| 195 | chr.20 |
| 196 | 20q13.1–q13.2 |
| 197 | 7p15–p21 |
| 198 | 19q13.3 |
| 199 | chr.2 |
| 201 | Xq22.1–q23 |
| 202 | Xq22.1–q23 |
| 204 | chr.20 |
| 205 | chr.5 |
| 206 | chr.2 |
| 208 | chr.5 |
| 214 | chr.12 |
| 220 | Xq28 |
| 224 | chr.7 |
| 227 | chr.14 |
| 230 | chr.7 |
| 231 | chr.7 |
| 238 | 19p13.3 |

TABLE IX

| Seq Id No | Tissue distribution |
|---|---|
| 1 | Br: 28; FB: 25; FK: 9; Ov: 17; Pl: 12; Pr: 4; SC: 2; SG: 4; Te: 9 |
| 2 | Br: 2; CP: 1; FB: 5; FK: 1; Pl: 3; Pr: 10; SG: 1 |
| 3 | Br: 1; CP: 1; FB: 33; FK: 13; Li: 2; Ov: 19; PG: 12; Pl: 27; Pr: 15; SG: 9; SI: 12 |
| 4 | AG: 1; CP: 1; LG: 1; Pr: 3; Te: 1 |
| 5 | Pa: 4; Pr: 2 |
| 6 | Li: 1; Pa: 4; Pr: 3 |
| 7 | Br: 9; Pr: 1; Te: 3 |
| 8 | Br: 4; FB: 1; Pr: 3; SG: 8 |
| 9 | Br: 4; Ce: 1; Co: 1; DM: 4; FB: 33; FK: 16; He: 3; Ki: 6; LC: 2; LG: 4; Li: 2; Lu: 2; Ly: 1; Ov: 36; Pa: 16; Pl: 2; Pr: 4; SC: 2; SI: 1; SN: 1; Sp: 1; UC: 3; Ut: 1 |
| 10 | Br: 1; CP: 1; Pr: 4; SG: 2 |
| 11 | Pr: 2; SG: 4 |
| 12 | Br: 1; CP: 1; FB: 5; FK: 1; Pl: 3; Pr: 9; SG: 1 |
| 13 | FL: 4; Li: 4 |
| 14 | Li: 4; Te: 3 |
| 15 | Te: 1 |
| 16 | Li: 3; Te: 6 |
| 17 | Ce: 1; FB: 6; Li: 1; Pl: 5; Te: 16 |
| 18 | Li: 7; Te: 6 |
| 19 | Li: 27; Te: 9 |
| 20 | Li: 1; Te: 3 |
| 21 | Te: 3 |
| 22 | Te: 3 |
| 23 | Li: 1; Te: 6 |
| 24 | Li: 2; Te: 2 |
| 25 | Te: 8 |
| 26 | Te: 5 |
| 27 | LC: 1; Te: 2 |
| 28 | Li: 1; Te: 2 |
| 29 | AG: 2; BM: 1; Br: 16; CP: 1; Co: 2; DM: 1; FB: 45; FK: 62; FL: 1; HP: 3; LC: 1; Li: 2; Mu: 1; Ov: 2; Pr: 10; SI: 5; SN: 3; Te: 9; UC: 1 |
| 30 | Li: 2 |
| 31 | Br: 3; CP: 1; FB: 1; FK: 6; Pr: 1; Te: 2 |
| 32 | Br: 1; CP: 1; Ce: 6; Ov: 1; Te: 2 |
| 33 | FK: 5; SC: 1 |
| 34 | Br: 1; FB: 2; FK: 48; Pl: 2; SN: 1 |
| 35 | Te: 1 |
| 36 | FB: 5; Pr: 1; SN: 1 |
| 37 | FB: 3; FK: 1; Li: 1; SG: 5 |
| 38 | FB: 10 |
| 39 | FB: 3 |
| 40 | Br: 1; DM: 1; FL: 1; Pl: 4; SG: 13 |
| 41 | FB: 3; FK: 1; Li: 1; SG: 5 |
| 42 | BM: 1; SG: 19 |
| 43 | SG: 1 |
| 44 | CP: 1; FB: 1; Mu: 2; Pl: 9; SG: 7 |
| 45 | BM: 1; SG: 20 |
| 46 | BM: 1; DM: 1; FB: 5; FK: 6; FL: 1; He: 1; Ki: 2; Ov: 9; Pl: 1; SG: 1; SI: 1; Te: 1 |
| 47 | Br: 4; FB: 4; Pr: 3; SG: 8 |
| 48 | Br: 12; Ce: 1; Co: 1; FB: 5; FK: 4; FL: 5; HP: 1; Ki: 1; LC: 1; Li: 6; Ov: 8; Pl: 105; SC: 1; SG: 8; Te: 4 |
| 49 | Br: 7; Ce: 1; Co: 1; FK: 4; HP: 1; Ki: 1; LC: 1; Li: 5; Ov: 8; Pl: 5; SC: 1; Te: 1 |
| 50 | AG: 1; CP: 4; Ce: 1; DM: 2; FB: 6; FK: 4; FL: 2; HP: 2; LC: 1; LG: 3; Li: 31; Lu: 3; Mu: 1; Ov: 25; Pl: 15; Pr: 20; SC: 1; Te: 75; UC: 5; Ut: 1 |
| 51 | FL: 1 |
| 52 | Br: 2; CP: 1; FB: 3; FK: 1; FL: 5; LC: 2; Pl: 1; Pr: 2; UC: 2 |
| 53 | Br: 3; FK: 4; FL: 4; HP: 1; Li: 3; Pl: 11; SG: 1; Te: 1 |
| 54 | Br: 15; Ce: 1; FB: 10; FK: 10; FL: 1; He: 1; Ki: 6; LC: 1; Li: 4; Ov: 32; Pa: 3; Pl: 2; Pr: 4; SC: 1; SN: 2; Sp: 4; Te: 8; UC: 1; Ut: 1 |
| 55 | FL: 2 |
| 56 | Br: 1; FB: 1; FL: 1; Te: 1 |
| 57 | FL: 4 |
| 58 | FL: 1; Li: 1 |
| 59 | FB: 3; FK: 1; Li: 1; SG: 5 |
| 60 | Br: 1; FB: 1; FL: 1; Pr: 2 |
| 61 | Br: 2; Pl: 1 |
| 62 | Br: 6; CP: 1; Ce: 7; FB: 37; FK: 4; FL: 1; Pl: 6; Pr: 1; SG: 3; SN: 3; Te: 1; UC: 1 |
| 63 | Br: 10 |

TABLE IX-continued

| Seq Id No | Tissue distribution |
|---|---|
| 64 | Br: 2; CP: 2 |
| 65 | Br: 1; FB: 11; LG: 1; Th: 1 |
| 66 | Br: 30; Ce: 1; Co: 1; FB: 60; FK: 15; FL: 3; HP: 1; Ki: 1; LC: 1; Li: 6; Ov: 57; PG: 9; Pl: 145; Pr: 21; SC: 1; SI: 4; Te: 4 |
| 67 | Br: 4; CP: 1; FB: 14; Ki: 1; Li: 1; Lu: 2; Pr: 1; Te: 1 |
| 68 | Br: 10 |
| 69 | AG: 1; Br: 48; FB: 3; FK: 5; HP: 1; He: 1; Li: 1; Pl: 11; SC: 2; SG: 1; Te: 2; Ut: 1 |
| 70 | Br: 11; DM: 1; He: 1 |
| 71 | DM: 1; He: 1 |
| 72 | Br: 9; Pr: 1; Te: 2 |
| 73 | Br: 8; Pr: 1 |
| 74 | Br: 5 |
| 76 | AG: 1; Br: 49; FB: 4; FK: 5; HP: 1; He: 1; LC: 1; Li: 1; Pl: 11; SC: 2; SG: 1; Te: 2; Ut: 1 |
| 77 | Br: 2; FK: 2; HP: 1; LC: 1; Li: 2; Ov: 14; Pl: 1; Pr: 14; Te: 5 |
| 78 | Br: 9; Ce: 1; DM: 1; FB: 21; FK: 18; FL: 1; HP: 1; He: 1; Ki: 9; LC: 2; LG: 4; Li: 2; Lu: 2; Ov: 34; Pl: 3; Pr: 4; SC: 1; SI: 2; SN: 2; Sp: 1; Ut: 1 |
| 79 | Pr: 1 |
| 80 | Br: 9; CP: 2; Co: 1; DM: 6; FB: 1; FK: 6; He: 2; Ki: 4; LC: 1; LG: 1; Li: 7; Ov: 40; Pa: 1; Pl: 2; Pr: 1; SN: 2; Sp: 1; Te: 12; UC: 1; Ut: 3 |
| 81 | FK: 1; Te: 1 |
| 82 | Li: 1 |
| 83 | Br: 2; CP: 1; FB: 10; FK: 2; Ki: 3; Li: 7; Ov: 10; SC: 1; SN: 1; Te: 1; UC: 1 |
| 84 | Br: 5; FB: 14; FK: 9; Li: 6; Ov: 17; SG: 8; Te: 8 |
| 85 | Li: 6; Te: 2 |
| 86 | Li: 2; Te: 2 |
| 87 | Br: 1; FB: 35; FK: 31; Li: 20; Ov: 37; PG: 5; Pl: 69; SI: 5; Te: 5 |
| 88 | Li: 1; Pr: 1; Te: 7; Ut: 2 |
| 89 | Te: 1 |
| 90 | Te: 2 |
| 91 | FB: 15; FK: 3; Li: 2; Ov: 17; Pr: 4; SG: 7; Te: 4 |
| 92 | Te: 2 |
| 93 | Br: 4; FB: 1; SN: 1; Te: 2 |
| 94 | Te: 1 |
| 95 | Li: 2 |
| 96 | AG: 1; Br: 1; FB: 1 |
| 97 | FK: 5; Te: 2 |
| 98 | Te: 3 |
| 99 | Br: 3; FB: 29; FK: 1; Li: 10; Ov: 1; Pl: 16; Pr: 2; SG: 1; Te: 49 |
| 100 | Br: 2; FB: 3; FK: 1; Ov: 3; Te: 1 |
| 101 | Br: 10; FB: 34; FK: 1; Ov: 1; Pl: 85; Pr: 1; Ut: 1 |
| 102 | FB: 6 |
| 103 | FB: 6; Li: 3; Pl: 1; Pr: 1; SG: 1; Te: 7 |
| 104 | Br: 26; CP: 1; FB: 8; FK: 131; Pl: 20; Pr: 20 |
| 105 | Br: 3; CP: 2; DM: 2; FB: 11; FK: 3; LG: 2; Ov: 1; Pl: 6; SC: 2; SG: 1; SN: 4 |
| 106 | FB: 4 |
| 107 | Br: 3; FB: 50; FK: 59; FL: 3; Pr: 1 |
| 108 | Br: 1; FB: 8; Li: 1; Lu: 1 |
| 109 | FB: 11; Pr: 21 |
| 110 | Br: 14; Ce: 1; FB: 5; FK: 5; FL: 1; HP: 1; He: 2; Ki: 3; LC: 1; Li: 4; Lu: 1; Ov: 7; Pl: 2; Pr: 1; SI: 1; Sp: 1; UC: 1 |
| 111 | Br: 1; Ce: 1; FK: 1; HP: 1; He: 2; Ki: 3; LC: 1; Li: 3; Lu: 1; Ov: 7; Sp: 1; UC: 1 |
| 112 | Br: 1; HP: 1; Lu: 1; Pr: 1; SG: 9; Ut: 1 |
| 113 | HP: 1; SG: 4 |
| 114 | FK: 9 |
| 115 | AG: 1; Br: 3; CP: 1; FB: 14; FK: 19; FL: 1; HP: 1; Pr: 1; SG: 1 |
| 116 | Br: 5; CP: 1; Ce: 1; Co: 1; DM: 5; FK: 3; FL: 1; LC: 3; LG: 1; Lu: 1; Ov: 23; Pl: 1; Te: 8; UC: 2; Ut: 4 |
| 117 | Br: 1; Ce: 1; FB: 1; FK: 1; FL: 2; Pl: 3; SN: 1; Te: 1; UC: 1 |
| 118 | CP: 1; DM: 1; FB: 5; FK: 2; FL: 2; He: 1; Lu: 1; Ly: 1; Ov: 23; Pr: 1; SN: 2; Sp: 2; Ut: 1 |
| 119 | Li: 2; Te: 7 |
| 120 | Br: 6; Co: 2; FB: 1; FK: 6; FL: 1; Ov: 3; Pl: 32; Pr: 1; SN: 1 |
| 121 | AG: 1; Br: 4 |
| 122 | Br: 5 |
| 123 | Br: 1 |
| 124 | Br: 2; Ki: 2; Li: 1; Ov: 7; UC: 1 |
| 125 | Br: 2; FB: 1; FL: 6; He: 1; Li: 1; Ov: 1; Pl: 2; Pr: 10; Te: 1; Th: 1 |
| 126 | Br: 1 |
| 127 | BM: 1; Br: 2; CP: 2; FB: 1; FK: 3; HP: 1; He: 1; LG: 1; Pl: 1; Pr: 1; SC: 2; SG: 2; Te: 5; Ut: 3 |
| 128 | Br: 1 |
| 129 | Br: 2; FB: 6; Li: 1; SG: 3; Te: 2 |
| 130 | Br: 25; FB: 3; FL: 2 |
| 131 | Br: 1 |
| 132 | Br: 1 |
| 133 | Br: 1 |
| 134 | Br: 2; SN: 1 |
| 135 | Br: 1 |
| 136 | AG: 1; Br: 1; FL: 1 |
| 137 | Br: 1; Ce: 1; FB: 1; FK: 1; FL: 2; Pl: 3; SN: 1; Te: 1; UC: 1 |
| 138 | Br: 43 |
| 139 | Br: 11; CP: 2; Co: 1; DM: 6; FB: 1; FK: 6; He: 2; Ki: 4; LC: 1; LG: 1; Ov: 40; Pa: 1; Pl: 2; Pr: 1; SN: 2; Sp: 1; Te: 9; UC: 1; Ut: 3 |
| 140 | Br: 23; Ce: 1; DM: 3; FB: 38; FK: 17; FL: 2; HP: 1; He: 1; Ki: 8; LC: 3; LG: 2; Li: 6; Lu: 1; Ly: 1; Ov: 40; Pr: 4; SC: 2; SN: 4; Sp: 1; Te: 5; UC: 1; Ut: 1 |
| 141 | Br: 39; FB: 3; SN: 2 |
| 142 | Br: 10; SN: 2 |
| 143 | Br: 26; FK: 2; HP: 1; LC: 1; Li: 2; Ov: 14; Pl: 3; Pr: 3; Te: 5 |
| 144 | Br: 14; Pr: 2 |
| 145 | FB: 12; LG: 1; Pr: 4; Te: 1; Ut: 2 |
| 146 | Li: 1; Ov: 2; Pr: 5; SG: 11 |
| 147 | Li: 1; Te: 1 |
| 148 | Br: 1; FB: 1; Li: 1; Te: 1 |
| 149 | Br: 3; FB: 5; FK: 5; Li: 1; Pl: 8; Te: 5 |
| 150 | FK: 6; Pr: 2; SG: 8 |
| 151 | FK: 9 |
| 152 | FK: 6; Pr: 2; SG: 9 |
| 153 | Te: 1 |
| 154 | FB: 28; Ov: 4 |
| 155 | Br: 21; Ce: 1; FB: 32; FK: 4 |
| 156 | Br: 5; CP: 1; FB: 16; FK: 3; He: 1; Ki: 5; Li: 1; Ov: 15; Pl: 3; SG: 2; SI: 1; Sp: 1; UC: 1 |
| 157 | FB: 14; FK: 1; FL: 1; SG: 1 |
| 158 | FB: 7 |
| 159 | FB: 10 |
| 160 | Ce: 2; FB: 12 |
| 161 | Ce: 2 |
| 162 | FB: 28; Ov: 2 |
| 163 | FB: 14; FK: 1; FL: 1; SG: 1 |
| 164 | FK: 4; Pr: 1; SG: 9 |
| 165 | Br: 4; Co: 1; Ki: 1; Ov: 2; Pr: 4; SG: 1 |
| 166 | FK: 6; Pr: 2; SG: 9 |
| 167 | Br: 1; FB: 1; SG: 5 |
| 168 | Br: 1; FB: 5; FK: 7; SG: 1; UC: 1 |
| 169 | FK: 2 |
| 170 | FL: 12 |
| 171 | Br: 2; FB: 1; FK: 1; Pl: 7 |
| 172 | Br: 106; FB: 2; Pl: 7 |
| 173 | Br: 14; FB: 1; Pl: 2; Te: 1 |
| 174 | Br: 17; He: 1; Pl: 1; SC: 2; Te: 1 |
| 175 | Br: 14; Pr: 2 |
| 176 | Br: 106; FB: 2; Pl: 7 |
| 177 | Br: 114; FB: 7; FK: 7; Ov: 2; Pl: 7; Pr: 2; Te: 9 |
| 178 | Br: 16; CP: 2; FB: 2; FK: 2; FL: 1; Li: 1; Pl: 13; Pr: 3; SC: 1; Ut: 1 |
| 179 | FL: 1; HP: 2; Pr: 2; Te: 1 |
| 180 | Pr: 2 |
| 181 | FB: 1; Ov: 2; Pr: 1; UC: 1 |
| 182 | BM: 1; Br: 4; DM: 1; FB: 6; FK: 6; Ki: 5; LC: 2; LG: 1; Li: 1; Lu: 1; Ov: 15; Pl: 1; Pr: 2; SC: 1; Sp: 2; Te: 2; Ut: 1 |
| 183 | Br: 8; CP: 1; Co: 2; DM: 4; FB: 1; FK: 1; Ki: 4; LC: 1; Li: 3; Ov: 33; Pl: 1; Pr: 5; SC: 2; SN: 1; Sp: 1; Te: 5; UC: 1; Ut: 2 |
| 184 | Pr: 1 |
| 185 | FB: 2; Li: 1; Ov: 1; SG: 7; Te: 5 |
| 186 | Te: 3 |
| 187 | Te: 1 |
| 188 | Br: 18; CP: 1; DM: 5; FB: 40; FK: 23; FL: 2; He: 3; Ki: 10; LC: 2; LG: 1; Li: 13; Lu: 3; Ly: 2; Mu: 1; Ov: 54; Pl: 5; Pr: 14; SC: 2; SG: 2; SI: 1; SN: 4; Sp: 3; Te: 4; UC: 4 |
| 189 | Li: 1; Te: 1 |
| 190 | Br: 7; CP: 1; FB: 1; FK: 4; FL: 5; He: 1; Li: 1; Ov: 1; Pl: 2; Pr: 4; |

TABLE IX-continued

| Seq Id No | Tissue distribution |
|---|---|
| | SG: 1 |
| 191 | Li: 2; Te: 4 |
| 192 | AG: 1; Br: 2; CP: 1; FB: 32; FK: 1; Li: 1; Ov: 36; Pl: 49; Pr: 3; SC: 1; SG: 4; SN: 4; Te: 9; UC: 1; Ut: 2 |
| 193 | FB: 31; FK: 75; FL: 7; Ov: 12; Pl: 23; Pr: 8; SG: 3; Te: 16 |
| 194 | Te: 2 |
| 195 | Te: 7 |
| 196 | Te: 2 |
| 197 | Te: 3 |
| 198 | Li: 10; Te: 43 |
| 199 | Br: 35; CP: 3; FB: 39; FK: 56; FL: 7; HP: 1; LG: 1; Li: 1; Ly: 1; Ov: 2; Pl: 10; Pr: 8; SG: 1; Te: 4; Ut: 2 |
| 200 | FB: 17; FK: 9; FL: 5; Ov: 21; Pl: 41; Te: 3 |
| 201 | FK: 16; SI: 1 |
| 202 | Br: 1; Co: 1; FB: 111; FK: 25; He: 1; Li: 4; Ov: 3; Pr: 6; Te: 1 |
| 204 | Te: 7 |
| 205 | Li: 7; Te: 28 |
| 206 | FB: 28; Li: 2; Ov: 23; PG: 11; Pl: 45; SG: 17; SI: 11; Te: 9 |
| 207 | FB: 16; FK: 1; Ov: 1; SC: 1; Te: 1 |
| 208 | FB: 5 |
| 209 | FB: 6 |
| 210 | Br: 1; FB: 22 |
| 211 | Br: 2; Ce: 3; FB: 6; FK: 1 |
| 212 | Br: 1; Co: 2; FB: 22; FK: 2; LG: 2; Mu: 2; Pl: 2; SG: 4 |
| 213 | Br: 2; DM: 1; FB: 8; FK: 8; FL: 1; Ki: 1; LG: 3; Ov: 5; Pa: 1; Pl: 4; Pr: 1; SN: 2; UC: 1 |
| 214 | FB: 7 |
| 215 | FB: 4 |
| 216 | Ov: 3; SG: 3 |
| 217 | Br: 4; CP: 2; DM: 1; FB: 9; FK: 3; Ki: 2; LC: 1; LG: 1; Lu: 3; Ly: 1; Ov: 14; Pl: 1; Pr: 1; SC: 1; SG: 2; Sp: 1; Te: 1; Ut: 1 |
| 218 | FB: 4; FK: 2; Pl: 1; Pr: 11; SG: 1 |
| 219 | Br: 7; CP: 3; FB: 2; FL: 1; HP: 4; Lu: 1; Ly: 2; Mu: 1; Ov: 3; Pl: 1; Pr: 1; SN: 2; Te: 1 |
| 220 | Br: 1; FL: 1; Pl: 2 |
| 221 | Co: 1; FB: 2; FL: 1; Li: 1; Pl: 2 |
| 222 | FL: 1; SG: 2 |
| 223 | Li: 1; Te: 1 |
| 225 | Li: 10 |
| 226 | Li: 1; Te: 4 |
| 227 | Li: 1 |
| 228 | Br: 1 |
| 229 | Br: 3 |
| 230 | Br: 5; Ce: 1; Co: 1; DM: 3; FB: 1; FK: 1; He: 1; LC: 1; LG: 2; Ov: 16; Pl: 3; Pr: 1; Te: 2; Ut: 1 |
| 231 | Br: 3; Ce: 1; Co: 1; DM: 3; FB: 1; FK: 1; He: 1; LC: 1; LG: 2; Ov: 16; Pl: 3; Pr: 1; Te: 2; Ut: 1 |
| 232 | AG: 1; Br: 17; CP: 2; DM: 1; FB: 51; FK: 9; FL: 3; Li: 3; Ov: 3; Pl: 2; Pr: 10; SC: 1; SG: 5; Te: 2; Ut: 1 |
| 233 | Br: 13 |
| 234 | Br: 5 |
| 235 | Br: 1; Pl: 1 |
| 236 | Br: 9 |
| 237 | Br: 22; DM: 2; FB: 17; FK: 9; Ki: 4; LG: 1; Li: 1; Lu: 2; Ov: 24; Pr: 3; SC: 1; SI: 1; SN: 2; Te: 2 |
| 238 | Br: 17 |
| 239 | Br: 11 |
| 240 | Br: 28; Ce: 1; DM: 5; FB: 52; FK: 40; FL: 2; HP: 1; He: 2; Ki: 3; LC: 1; LG: 3; Li: 1; Ly: 1; Ov: 28; Pl: 1; Pr: 5; SC: 1; SI: 1; SN: 3; Sp: 6; Te: 1; Ut: 1 |
| 241 | Br: 4; Ce: 1; DM: 5; FB: 5; FK: 7; HP: 1; He: 2; Ki: 3; LC: 1; LG: 3; Li: 1; Ly: 1; Ov: 28; Pl: 1; SC: 1; SN: 3; Sp: 6; Te: 1; UC: 1; Ut: 1 |

TABLE X

| Seq Id No | Low frequency expression | High frequency expression |
|---|---|---|
| 1 | — | Br, Ov |
| 2 | — | Pr |
| 3 | Br, Te | Ov, PG, Pl, SI |
| 4 | — | AG |
| 5 | — | Pa |
| 6 | — | Pa |
| 7 | — | Br |
| 8 | — | SG |
| 9 | Br, Te | DM, He, Ki, Ov, Pa |
| 10 | — | Pr |
| 11 | — | SG |
| 12 | — | Pr |
| 13 | — | FL, Li |
| 14 | — | Li, Te |
| 15 | — | Te |
| 16 | — | Li, Te |
| 17 | — | Te |
| 18 | — | Li, Te |
| 19 | — | Li, Te |
| 20 | — | Te |
| 21 | — | Te |
| 22 | — | Te |
| 23 | — | Te |
| 24 | — | Li |
| 25 | — | Te |
| 26 | — | Te |
| 27 | — | LC, Te |
| 28 | — | Te |
| 29 | Pl | FK |
| 30 | — | Li |
| 31 | — | FK |
| 32 | — | Ce |
| 33 | — | FK, SC |
| 34 | FB | FK |
| 35 | — | Te |
| 36 | — | SN |
| 37 | — | SG |
| 38 | — | FB |
| 40 | — | SG |
| 41 | — | SG |
| 42 | — | BM, SG |
| 43 | — | SG |
| 44 | — | Mu, Pl, SG |
| 45 | — | BM, SG |
| 46 | — | BM, Ki, Ov |
| 47 | — | SG |
| 48 | FB, FK, Pr | Pl |
| 49 | — | Ki, Ov |
| 50 | Br, FB, FK, SG | Li, Ov, Te |
| 51 | — | FL |
| 52 | — | FL, LC, UC |
| 53 | — | Pl |
| 54 | — | Ki, Ov, Pa, Sp |
| 55 | — | FL |
| 57 | — | FL |
| 58 | — | FL |
| 59 | — | SG |
| 62 | — | Ce, FB |
| 63 | — | Br |
| 64 | — | CP |
| 65 | — | FB, Th |
| 66 | FK, SG, Te | Ov, PG, Pl |
| 67 | — | FB, Ki, Lu |
| 68 | — | Br |
| 69 | FB | Br |
| 70 | — | Br, DM, He |
| 71 | — | DM, He |
| 72 | — | Br |
| 73 | — | Br |
| 74 | — | Br |
| 75 | — | Br |
| 76 | FB | Br |
| 77 | FB | Ov, Pr |
| 78 | — | Ki, Ov |
| 80 | FB | DM, Ki, Ov |
| 82 | — | Li |
| 83 | — | Ki, Li, Ov |
| 84 | — | Ov |
| 85 | — | Li |

TABLE X-continued

| Seq Id No | Low frequency expression | High frequency expression |
|---|---|---|
| 86 | — | Li |
| 87 | Br, Pr, SG | Ov, PG, Pl |
| 88 | — | Te, Ut |
| 89 | — | Te |
| 90 | — | Te |
| 91 | — | Ov |
| 92 | — | Te |
| 93 | — | SN |
| 94 | — | Te |
| 95 | — | Li |
| 96 | — | AG |
| 97 | — | FK |
| 98 | — | Te |
| 99 | FK | Te |
| 100 | — | Ov |
| 101 | FK | Pl |
| 102 | — | FB |
| 103 | — | Te |
| 104 | FB, Li, SG, Te | FK |
| 105 | — | DM, SN |
| 106 | — | FB |
| 107 | Br, Pl | FB, FK |
| 108 | — | FB, Lu |
| 109 | — | Pr |
| 110 | — | He, Ki, Ov |
| 111 | — | Ce, He, Ki, Lu, Ov |
| 112 | — | Lu, SG |
| 113 | — | HP, SG |
| 114 | — | FK |
| 115 | — | FK |
| 116 | FB | DM, LC, Ov, Ut |
| 117 | — | Ce, UC |
| 118 | — | Ov, Sp |
| 119 | — | Te |
| 120 | FB | Co, Pl |
| 121 | — | AG, Br |
| 122 | — | Br |
| 124 | — | Ki, Ov |
| 125 | — | FL, Pr, Th |
| 127 | — | BM, SC, Ut |
| 130 | — | Br |
| 134 | — | SN |
| 136 | — | AG |
| 137 | — | Ce, UC |
| 138 | FB | Br |
| 139 | FB | DM, Ki, Ov, Ut |
| 140 | Pl | Ki, Ov |
| 141 | — | Br |
| 142 | — | Br, SN |
| 143 | FB | Br, Ov |
| 144 | — | Br |
| 145 | — | FB, Ut |
| 146 | — | SG |
| 149 | — | Pl |
| 150 | — | FK, SG |
| 151 | — | FK |
| 152 | — | FK, SG |
| 153 | — | Te |
| 154 | — | FB, Ov |
| 155 | — | Br, FB |
| 156 | — | Ki, Ov |
| 157 | — | FB |
| 158 | — | FB |
| 159 | — | FB |
| 160 | — | Ce, FB |
| 161 | — | Ce |
| 162 | — | FB |
| 163 | — | FB |
| 164 | — | SG |
| 165 | — | Co, Ki, Ov |
| 166 | — | FK, SG |
| 167 | — | SG |
| 168 | — | FK |
| 169 | — | FK |
| 170 | — | FL |
| 171 | — | Pl |
| 172 | FB, FK, Pr | Br |
| 173 | — | Br |
| 174 | — | Br, He, SC |
| 175 | — | Br |
| 176 | FB, FK, Pr | Br |
| 177 | FB | Br |
| 178 | — | Br, Pl |
| 179 | — | HP |
| 180 | — | Pr |
| 181 | — | Ov, UC |
| 182 | — | Ki, Ov, Sp |
| 183 | FB | DM, Ki, Ov |
| 185 | — | SG, Te |
| 186 | — | Te |
| 187 | — | Te |
| 188 | Pl | DM, Ki, Ov |
| 190 | — | FL |
| 191 | — | Te |
| 192 | Br, FK | Ov, Pl |
| 193 | Br | FK, Ov |
| 194 | — | Te |
| 195 | — | Te |
| 196 | — | Te |
| 197 | — | Te |
| 198 | FB | Li, Te |
| 199 | — | FK |
| 200 | Br | Ov, Pl |
| 201 | — | FK |
| 202 | — | FK |
| 203 | Br, Pl | FB |
| 204 | — | Te |
| 205 | — | Li, Te |
| 206 | Br, FK, Pr | Ov, PG, Pl, SG, SI |
| 207 | — | FB |
| 208 | — | FB |
| 209 | — | FB |
| 210 | — | FB |
| 211 | — | Ce |
| 212 | — | Co, FB, Mu |
| 213 | — | Ki, LG, Ov |
| 214 | — | FB |
| 215 | — | FB |
| 216 | — | Ov, SG |
| 217 | — | Ki, Lu, Ov |
| 218 | — | Pr |
| 219 | — | CP, HP, Ly, Ov, SN |
| 221 | — | Co |
| 222 | — | SG |
| 223 | — | SG |
| 225 | — | Li |
| 226 | — | Te |
| 227 | — | Li |
| 229 | — | Br |
| 230 | — | DM, Ov |
| 231 | — | DM, Ov |
| 232 | — | FB |
| 233 | — | Br |
| 234 | — | Br |
| 236 | — | Br |
| 237 | — | Ki, Lu, Ov |
| 238 | — | Br |
| 239 | — | Br |
| 240 | Pl, Te | DM, FK, Ki, Ov, Sp |
| 241 | FB | DM, He, Ki, Ov, Sp |

TABLE XI

| Seq Id No | Subcellular localization |
|---|---|
| 7 | nuclear |
| 13 | extracellular, including cell wall |
| 20 | mitochondrial |
| 21 | nuclear |

TABLE XI-continued

| Seq Id No | Subcellular localization |
|---|---|
| 26 | nuclear |
| 35 | nuclear |
| 37 | endoplasmic reticulum |
| 38 | extracellular, including cell wall |
| 39 | endoplasmic reticulum |
| 41 | endoplasmic reticulum |
| 59 | endoplasmic reticulum |
| 70 | nuclear |
| 71 | nuclear |
| 72 | nuclear |
| 78 | nuclear |
| 98 | nuclear |
| 99 | nuclear |
| 105 | mitochondrial |
| 108 | endoplasmic reticulum |
| 116 | mitochondrial |
| 117 | mitochondrial |
| 134 | nuclear |
| 135 | nuclear |
| 137 | mitochondrial |
| 159 | nuclear |
| 160 | nuclear |
| 161 | nuclear |
| 171 | nuclear |
| 178 | endoplasmic reticulum |
| 182 | nuclear |
| 184 | nuclear |
| 185 | endoplasmic reticulum |
| 186 | nuclear |
| 187 | nuclear |
| 188 | nuclear |
| 194 | nuclear |
| 195 | nuclear |
| 196 | nuclear |
| 200 | mitochondrial |
| 204 | nuclear |
| 205 | nuclear |
| 206 | nuclear |
| 211 | nuclear |
| 212 | nuclear |
| 213 | nuclear |
| 214 | endoplasmic reticulum |
| 215 | endoplasmic reticulum |
| 216 | endoplasmic reticulum |
| 218 | nuclear |
| 220 | endoplasmic reticulum |
| 224 | nuclear |
| 225 | nuclear |
| 230 | mitochondrial |
| 231 | mitochondrial |
| 238 | cytoplasmic |

TABLE XII

| Seq Id No in priority applications | Internal designation | Seq Id No in present application |
|---|---|---|
| 119 | 119-003-4-0-C2-CS | 1 |
| 220 | 105-016-1-0-D3-CS | 2 |
| 345 | 105-016-3-0-G10-CS | 3 |
| 334 | 105-026-1-0-A5-CS | 4 |
| 159 | 105-031-1-0-A11-CS | 5 |
| 219 | 105-031-2-0-D3-CS | 6 |
| 250 | 105-035-2-0-C6-CS | 7 |
| 217 | 105-037-2-0-H11-CS | 8 |
| 340 | 105-053-4-0-E8-CS | 9 |
| 115 | 105-074-3-0-H10-CS | 10 |
| 31 | 105-089-3-0-G10-CS | 11 |
| 198 | 105-095-2-0-G11-CS | 12 |
| 154 | 106-006-1-0-E3-CS | 13 |
| 366 | 106-037-1-0-E9-CS.cor | 14 |
| 366 | 106-037-1-0-E9-CS.fr | 15 |
| 79 | 106-043-4-0-H3-CS | 16 |

TABLE XII-continued

| Seq Id No in priority applications | Internal designation | Seq Id No in present application |
|---|---|---|
| 95 | 110-007-1-0-C7-CS | 17 |
| 364 | 114-016-1-0-H8-CS | 18 |
| 246 | 116-004-3-0-A6-CS | 19 |
| 187 | 116-054-3-0-E6-CS | 20 |
| 203 | 116-055-1-0-A3-CS | 21 |
| 298 | 116-055-2-0-F7-CS | 22 |
| 277 | 116-088-4-0-A9-CS | 23 |
| 41 | 116-091-1-0-D9-CS | 24 |
| 353 | 116-110-2-0-F4-CS | 25 |
| 78 | 116-111-1-0-H9-CS | 26 |
| 245 | 116-111-4-0-B3-CS | 27 |
| 104 | 116-115-2-0-F8-CS | 28 |
| 259 | 116-119-3-0-H5-CS | 29 |
| 269 | 117-001-5-0-G3-CS | 30 |
| 166 | 145-25-3-0-B4-CS.cor | 31 |
| 166 | 145-25-3-0-B4-CS.fr | 32 |
| 169 | 145-56-3-0-D5-CS | 33 |
| 312 | 145-59-2-0-A7-CS | 34 |
| 273 | 157-15-4-0-B11-CS | 35 |
| 190 | 160-103-1-0-F11-CS | 36 |
| 244 | 160-37-2-0-H7-CS | 37 |
| 151 | 160-58-3-0-H3-CS | 38 |
| 149 | 160-75-4-0-A9-CS | 39 |
| 307 | 174-10-2-0-F8-CS | 40 |
| 264 | 174-33-3-0-F6-CS | 41 |
| 168 | 174-38-1-0-B6-CS | 42 |
| 202 | 174-38-3-0-C9-CS | 43 |
| 28 | 174-39-2-0-A3-CS | 44 |
| 331 | 174-41-1-0-A6-CS | 45 |
| 258 | 174-5-3-0-H7-CS | 46 |
| 84 | 174-7-4-0-H1-CS | 47 |
| 294 | 175-1-3-0-E5-CS.cor | 48 |
| 294 | 175-1-3-0-E5-CS.fr | 49 |
| 310 | 180-19-4-0-F4-CS | 50 |
| 311 | 181-10-1-0-D10-CS | 51 |
| 263 | 181-16-1-0-G7-CS | 52 |
| 304 | 181-16-2-0-A7-CS | 53 |
| 109 | 181-20-3-0-B5-CS | 54 |
| 121 | 181-3-3-0-B8-CS | 55 |
| 181 | 181-3-3-0-C9-CS | 56 |
| 191 | 182-1-2-0-D12-CS | 57 |
| 193 | 184-1-4-0-C11-CS | 58 |
| 192 | 184-4-1-0-A11-CS | 59 |
| 116 | 187-12-4-0-A8-CS | 60 |
| 268 | 187-2-2-0-A3-CS | 61 |
| 123 | 187-31-0-0-f12-CS | 62 |
| 234 | 187-34-0-0-l12-CS | 63 |
| 185 | 187-37-0-0-c10-CS | 64 |
| 279 | 187-38-0-0-l10-CS | 65 |
| 114 | 187-39-0-0-k12-CS | 66 |
| 211 | 187-41-0-0-i21-CS | 67 |
| 236 | 188-11-1-0-B3-CS | 68 |
| 35 | 188-18-4-0-A9-CS | 69 |
| 299 | 188-28-4-0-B12-CS.cor | 70 |
| 299 | 188-28-4-0-B12-CS.fr | 71 |
| 72 | 188-28-4-0-D4-CS | 72 |
| 242 | 188-41-1-0-B8-CS.cor | 73 |
| 242 | 188-41-1-0-B8-CS.fr | 74 |
| 173 | 188-45-1-0-D9-CS | 75 |
| 106 | 188-9-2-0-E1-CS | 76 |
| 130 | 105-079-3-0-A11-CS | 77 |
| 323 | 105-092-1-0-H7-CS | 78 |
| 160 | 105-141-4-0-H9-CS | 79 |
| 272 | 109-013-1-0-B9-CS | 80 |
| 226 | 110-008-4-0-D9-CS | 81 |
| 333 | 114-001-3-0-A2-CS | 82 |
| 315 | 114-028-2-0-C1-CS | 83 |
| 300 | 114-032-1-0-H10-CS | 84 |
| 57 | 114-043-2-0-A10-CS | 85 |
| 137 | 114-044-1-0-C5-CS | 86 |
| 107 | 116-003-3-0-D10-CS | 87 |
| 164 | 116-003-3-0-G12-CS | 88 |
| 108 | 116-011-2-0-F11-CS | 89 |
| 101 | 116-033-3-0-E4-CS | 90 |
| 157 | 116-041-4-0-B6-CS | 91 |

TABLE XII-continued

| Seq Id No in priority applications | Internal designation | Seq Id No in present application |
|---|---|---|
| 75 | 116-044-2-0-C4-CS | 92 |
| 322 | 116-075-1-0-E6-CS | 93 |
| 124 | 116-094-4-0-G5-CS | 94 |
| 289 | 117-005-3-0-F2-CS | 95 |
| 122 | 121-007-3-0-D9-CS | 96 |
| 208 | 145-91-3-0-D10-CS | 97 |
| 282 | 157-17-1-0-F4-CS | 98 |
| 129 | 160-11-3-0-G8-CS | 99 |
| 317 | 160-24-1-0-F12-CS | 100 |
| 308 | 160-24-2-0-E9-CS | 101 |
| 25 | 160-25-4-0-D2-CS | 102 |
| 243 | 160-31-3-0-A11-CS | 103 |
| 346 | 160-32-1-0-F6-CS | 104 |
| 60 | 160-37-1-0-A3-CS | 105 |
| 305 | 160-40-3-0-E9-CS | 106 |
| 48 | 160-58-3-0-E4-CS | 107 |
| 238 | 160-85-3-0-D4-CS | 108 |
| 251 | 160-95-3-0-A11-CS | 109 |
| 196 | 162-10-4-0-F9-CS.cor | 110 |
| 196 | 162-10-4-0-F9-CS.fr | 111 |
| 347 | 174-13-2-0-E4-CS | 112 |
| 77 | 174-46-2-0-B11-CS | 113 |
| 188 | 179-8-2-0-A6-CS | 114 |
| 235 | 180-22-3-0-B6-CS | 115 |
| 45 | 181-13-1-0-F7-CS | 116 |
| 265 | 181-15-4-0-F7-CS | 117 |
| 280 | 181-20-1-0-G7-CS | 118 |
| 281 | 184-15-3-0-D1-CS | 119 |
| 39 | 187-12-2-0-G11-CS | 120 |
| 165 | 187-2-2-0-A12-CS | 121 |
| 326 | 187-30-0-0-k23-CS | 122 |
| 330 | 187-36-0-0-e19-CS | 123 |
| 368 | 187-38-0-0-d22-CS | 124 |
| 71 | 187-39-0-0-b9-CS | 125 |
| 224 | 187-39-0-0-g6-CS | 126 |
| 90 | 187-45-0-0-l18-CS | 127 |
| 216 | 187-45-0-0-m21-CS | 128 |
| 83 | 187-45-0-0-n8-CS | 129 |
| 342 | 187-46-0-0-f23-CS | 130 |
| 262 | 187-5-1-0-A12-CS | 131 |
| 257 | 187-5-1-0-F6-CS | 132 |
| 293 | 187-5-2-0-B2-CS | 133 |
| 231 | 187-5-3-0-D5-CS | 134 |
| 287 | 187-51-0-0-f9-CS | 135 |
| 325 | 187-6-1-0-B9-CS | 136 |
| 309 | 187-6-4-0-C10-CS | 137 |
| 359 | 188-19-2-0-C8-CS | 138 |
| 68 | 188-22-4-0-G6-CS | 139 |
| 233 | 188-28-4-0-D11-CS | 140 |
| 369 | 188-29-1-0-E10-CS | 141 |
| 155 | 188-34-4-0-E5-CS | 142 |
| 327 | 188-9-3-0-A5-CS | 143 |
| 283 | 105-021-3-0-C3-CS | 144 |
| 29 | 105-037-4-0-H12-CS | 145 |
| 100 | 105-073-2-0-A7-CS | 146 |
| 99 | 109-002-4-0-C6-CS | 147 |
| 360 | 109-003-1-0-G4-CS | 148 |
| 321 | 116-118-4-0-A8-CS | 149 |
| 120 | 145-52-2-0-D12-CS | 150 |
| 230 | 145-7-2-0-G5-CS | 151 |
| 177 | 145-7-3-0-D3-CS | 152 |
| 43 | 157-17-2-0-C1-CS | 153 |
| 352 | 160-101-3-0-H2-CS | 154 |
| 47 | 160-12-1-0-D10-CS | 155 |
| 195 | 160-28-4-0-C4-CS | 156 |
| 344 | 160-31-3-0-E4-CS | 157 |
| 61 | 160-40-1-0-H4-CS | 158 |
| 237 | 160-54-1-0-F7-CS | 159 |
| 32 | 160-88-3-0-A8-CS.cor | 160 |
| 32 | 160-88-3-0-A8-CS.fr | 161 |
| 97 | 160-99-4-0-E4-CS | 162 |
| 249 | 161-5-4-0-B6-CS | 163 |
| 218 | 174-17-1-0-D6-CS | 164 |
| 266 | 174-32-4-0-F8-CS | 165 |
| 161 | 174-38-4-0-D11-CS | 166 |
| 113 | 174-8-2-0-C10-CS | 167 |
| 255 | 179-14-2-0-F11-CS | 168 |
| 24 | 179-9-4-0-B8-CS | 169 |
| 128 | 181-10-1-0-C9-CS | 170 |
| 58 | 187-5-3-0-C7-CS | 171 |
| 358 | 188-26-4-0-F5-CS | 172 |
| 171 | 188-27-3-0-G1-CS | 173 |
| 98 | 188-29-2-0-H1-CS | 174 |
| 133 | 188-31-1-0-E6-CS | 175 |
| 49 | 188-45-1-0-D3-CS | 176 |
| 42 | 188-5-1-0-H6-CS | 177 |
| 148 | 188-9-1-0-C10-CS | 178 |
| 319 | 105-016-3-0-C5-CS | 179 |
| 254 | 105-026-4-0-D9-CS | 180 |
| 55 | 105-053-2-0-D9-CS | 181 |
| 89 | 105-069-3-0-A11-CS | 182 |
| 212 | 105-076-4-0-F6-CS | 183 |
| 143 | 105-135-2-0-F9-CS | 184 |
| 179 | 106-023-4-0-F6-CS | 185 |
| 54 | 110-001-3-0-C11-CS | 186 |
| 354 | 110-002-3-0-F9-CS | 187 |
| 297 | 114-019-3-0-D9-CS | 188 |
| 291 | 114-029-1-0-C6-CS | 189 |
| 30 | 114-032-4-0-B1-CS | 190 |
| 363 | 114-070-2-0-H4-CS | 191 |
| 194 | 116-016-3-0-F11-CS | 192 |
| 76 | 116-022-4-0-G2-CS | 193 |
| 232 | 116-052-2-0-H8-CS | 194 |
| 139 | 116-053-4-0-B4-CS | 195 |
| 145 | 116-094-3-0-H2-CS | 196 |
| 206 | 116-112-4-0-C7-CS | 197 |
| 88 | 116-123-3-0-F12-CS | 198 |
| 69 | 123-008-1-0-C5-CS | 199 |
| 285 | 145-53-2-0-H8-CS | 200 |
| 96 | 145-57-2-0-C9-CS.cor | 201 |
| 96 | 145-57-2-0-C9-CS.fr | 202 |
| 26 | 145-7-3-0-B12-CS | 203 |
| 261 | 157-12-2-0-D1-CS | 204 |
| 349 | 157-16-2-0-D5-CS | 205 |
| 92 | 157-18-2-0-A7-CS | 206 |
| 81 | 160-103-1-0-B10-CS | 207 |
| 74 | 160-104-4-0-F3-CS | 208 |
| 66 | 160-22-2-0-D10-CS | 209 |
| 270 | 160-24-3-0-F12-CS | 210 |
| 318 | 160-3-2-0-H3-CS | 211 |
| 215 | 160-58-2-0-A2-CS | 212 |
| 214 | 160-73-1-0-B4-CS | 213 |
| 94 | 160-75-4-0-E6-CS | 214 |
| 73 | 160-97-3-0-E9-CS | 215 |
| 296 | 174-1-4-0-E9-CS | 216 |
| 127 | 174-12-4-0-C2-CS | 217 |
| 350 | 180-19-4-0-H2-CS | 218 |
| 320 | 181-10-4-0-G12-CS | 219 |
| 292 | 181-3-2-0-F6-CS | 220 |
| 125 | 181-4-4-0-A12-CS | 221 |
| 91 | 181-9-2-0-F12-CS.cor | 222 |
| 91 | 181-9-2-0-F12-CS.fr | 223 |
| 338 | 184-13-3-0-E11-CS | 224 |
| 102 | 184-4-2-0-D3-CS | 225 |
| 105 | 184-7-1-0-E7-CS | 226 |
| 112 | 184-8-4-0-G9-CS | 227 |
| 267 | 187-10-3-0-G9-CS | 228 |
| 260 | 187-32-0-0-m20-CS | 229 |
| 343 | 187-32-0-0-n21-CS.cor | 230 |
| 343 | 187-32-0-0-n21-CS.fr | 231 |
| 341 | 187-4-2-0-E6-CS | 232 |
| 59 | 187-40-0-0-i15-CS | 233 |
| 111 | 187-47-0-0-g24-CS | 234 |
| 40 | 187-9-3-0-A2-CS | 235 |
| 355 | 188-26-4-0-H1-CS | 236 |
| 37 | 188-35-3-0-G9-CS | 237 |
| 180 | 188-38-4-0-D8-CS | 238 |
| 152 | 188-41-1-0-E6-CS | 239 |
| 93 | 188-42-2-0-F3-CS.cor | 240 |
| 93 | 188-42-2-0-F3-CS.fr | 241 |

SEQUENCE LISTING (482 sequences)

SEQ ID NO: 1 - DNA, 2201 bp, Homo sapiens
  CDS 169..1692
  sig_peptide 169..249: Von Heijne matrix score 7.15265901862021 seq VLLLLLLERGMFS/SP
agatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttatggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttccaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgaaaaaaaaaaaaaaaaaaaaaaaaaaaaaaaaaagaaaaaaaaaaaaaaa

SEQ ID NO: 2 - DNA, 1631 bp, Homo sapiens
  CDS 148..1140
  sig_peptide 148..240: Von Heijne matrix score 10.0910253445132 seq LVLLLVTRSPVNA/CL
gtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaatggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctggggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcacaaaaaaaaaaaaaaaaa

SEQ ID NO: 3 - DNA, 1245 bp, Homo sapiens
  CDS 85..906
  sig_peptide 85..135: Von Heijne matrix score 3.86022363031904 seq GFVAALVAGGVAG/VS
aaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattatgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcggtactctgaacaatttcctcagaacctcttaataaataagtttggtaatgctgagaaaaaaaaaaaaaaaaaaaaaaaaaaaaaaaaaaaaaaaaaaaagaaaaaaaaaaaaaaaaa

SEQ ID NO: 4 - DNA, 1623 bp, Homo sapiens
  CDS 31..1248
  sig_peptide 31..135: Von Heijne matrix score 6.3770152988307 seq TLLLFAAPFGLLG/EK
aacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagcccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttatttttttttcacagggcaaaaaaaaaaaaaaaaa

SEQ ID NO: 5 - DNA, 1454 bp, Homo sapiens
  CDS 72..143
  sig_peptide 72..119: Von Heijne matrix score 5.68931280801877 seq LGMLLGLLMAACT/PS
gtgtctgccactcggctgccggaggccgaaggtccctgactatggctccccagagcctgccttcatctaggatggctcctctgggcatgctgcttgggctgctgatggccgcctgcacaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagggaggtgctcaccgtgcgcgtggtcacactgctctacgacctggtcacggagaagatgttcgccgaggaggaggctgagctgacccaggagatgtccccagagaagctgcagcagtatcgccaggtacacctcctgccakgcctgtgggaacagggctggtgcgagatcacggcccacctcctggcgctgcccgagcatgatgccygtgagaaggtgctgcwgacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccaaaaaaaaaaaaaaaaa

SEQ ID NO: 6 - DNA, 1639 bp, Homo sapiens
  CDS 111..1154
  sig_peptide 111..197: Von Heijne matrix score 4.68065944212013 seq LLGPLMAACFTFC/LS
agacggtcgccgccgcgtttgcgcagggggagctggtcgccgccgcggccgcctggaattgtgggagttgtgtctgccactcggctgccggaggccgaaggtccctgactatggctccccagagcctgccttcatctaggatggctcctctgggcatgctgcttgggccgctgatggccgcctgcttcaccttctgcctcagtcatcagaacctgaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaaaggctggatatcaacaccaacacctacacatctcaggatctcaagagtgcactggcaaaattcaaggagggggcagagatggagagttcaaaggaagacaaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcagatggacaatgcgcaggacctgctttcctttggtggtcttcaagtggtgatcaatgggctgaacagcacagagcccctcgtgaaggagtatgctgcgtttgtgctgggcgctgccttttccagcaaccccaaggtccaggtggaggccatcgaagggggagccctgcagaagctgctggtcatcctggccacggagcagccgctcactgcaaagaagaaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaagatgttcgccgaggagtaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggcaaaaaaaaaaaaaaaaa

SEQ ID NO: 7 - DNA, 1768 bp, Homo sapiens
  CDS 66..1256
  sig_peptide 66..173: Von Heijne matrix score 4.89555877630516 seq LLLLRLNDAALRA/LQ
agaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaaaaaaaaaaaaaaa

SEQ ID NO: 8 - DNA, 1510 bp, Homo sapiens
  CDS 190..1398
  sig_peptide 190..252: Von Heijne matrix score 5.8172934575094 seq ALLWAQEVGQVLA/GR
acggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcggtgagtgagtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccaggtgcagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagctccaaaaaaaaaaaaaaaaa

SEQ ID NO: 9 - DNA, 882 bp, Homo sapiens
  CDS 78..410
  sig_peptide 78..155: Von Heijne matrix score 10.0731536331164 seq LWLALVSCILTQA/SA
atggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtgacaggcgcctgtaatcccagctactcgggaggccaaggcaggagaattgctcgaactcagggggtggaggttgcagtgagttgagattgtgccattgcactccagcctgggcaacagagcaagactctgtctcaggcaaaaaaaaaaaaaaaaa

SEQ ID NO: 10 - DNA, 1849 bp, Homo sapiens
  CDS 84..299
  sig_peptide 84..134: Von Heijne matrix score 3.86022363031904 seq GFVAALVAGGVAG/VS
aaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttaataaggctggtggttttcatggaatatatgctggcgttccttctgctgctattggatcctttcctaatggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcgaagacaagaattatgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgtaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagaaaacggggtctgtggcagtactctgaacaatttcctcagaacctcttaataaataagtttggtaatgctgaggccaggccttttagagctttcatttgatctgtatctgatctttcatttcctgccacctgatggtggattcagcagaaggcaagatggttataattctaaaagaatagcttgtttgtttgtttgtttgggaaaaggagacttggggaagagttgtgtatgtgggtgtttctccccctagttaattcctgttgtgtaagggtaggctttgttgaaaaagaaagaaagattgaactacaggtgcatagcaagcactctttctgggtaactaggctgctggttttaattaccctcagatttcacccataaaaacgcacaattgtattattttacagagatgtgtccagcgccccctgtggtgtgtgagagaaagcagctgcaactcaagtgactaggtgggcccagctggcttcgtgcaggagggcacggtgggtgagccattctcgccattctcatgtcagactgaaaggagggcctgggccagctttgaaaaggcaggatgaaatggaaaggtcaccacacttagggattttagaccttgactaacaagctccaggtgtagaaaaattcaaaacaaaatgtcaggaatctagcagtgttgtctgccctggagcaaacaaacagtatgtgattttgcttcgcctattttttttttcttttttgggggaagataattaaaggcagaatgactgcgtttgtaaaagaaggaccaccaactatactgacatttataaatgaacctttattaaagacacttcaatgcaaaaaaaaaaaaaaaaa

SEQ ID NO: 11 - DNA, 565 bp, Homo sapiens
  CDS 55..468
  sig_peptide 55..99: Von Heijne matrix score 8.96936032049195 seq FTTLLFLAAVAGA/LV
attccccagaccttctgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaatccatagtggagaaaagtatcttactaacagaacaagcccttgcaaaagcaggaaaaggaatgcacggaggcgtgccaggtggaaaacaattcatcgaaaatggaagtgaatttgcacaaaaattactgaagaaattcagtctattaaaaccatgggcatgagaagctgaataatgggatcattggacttaaagccttaaatacccttgtagcccagagctattaaaacgaaagcatccaaaaaaaaaaaaaaaaa

SEQ ID NO: 12 - DNA, 1663 bp, Homo sapiens
  CDS 152..475
  sig_peptide 152..244: Von Heijne matrix score 10.0910253445132 seq LVLLLVTRSPVNA/CL
atgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagcaamsaggcgcccgagaacacgctggcggccattcggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaaggtaacattcgggatttttcttgtacatattagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaaaaaaaaaaaaaaa

SEQ ID NO: 13 - DNA, 744 bp, Homo sapiens
  CDS 112..552
  sig_peptide 112..183: Von Heijne matrix score 11.7298925418815 seq FVLGLGLTPPTLA/QD
tcacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcacgatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagcaaaaaaaaaaaaaaaa

SEQ ID NO: 14 - DNA, 1759 bp, Homo sapiens
  CDS 101..1243
  sig_peptide 101..199: Von Heijne matrix score 3.57142340200611 seq FLCLGMALCPRQA/TR
gtagagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaatgcagtagtatatacaatcttttgttttgcttcctttgatagttaataaattccgtttgttgaatcaataaaaaaaaaaaaaaa

SEQ ID NO: 15 - DNA, 1755 bp, Homo sapiens
  CDS 101..517
  sig_peptide 101..199: Von Heijne matrix score 3.57613483592743 seq FLCLGMALCLRQA/TR
gtagagtgctgaaggtcctgccaacggctctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgcatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttgttaaaaggcttgagtgatgaacttgcccttgtggatcttgatgaagacaaactgaagggtgagacgatggatcttcaacatggcagccctttcacgaaaatgccaatattgtttgtagcaaagattactttgtcacagcaaactccaacctagtgattatcacagcaggtgcacgccaagaaaagggagaaacgcgccttaatttagtccagcgaaatgtggccatcttcaagtaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataactaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaatgcagtagtatatacaatcttttgttttgcttcctttgatagttaataaattccgtttgttgaatcaataaaaaaaaaaaaaaa

SEQ ID NO: 16 - DNA, 936 bp, Homo sapiens
  CDS 59..853
  sig_peptide 59..100: Von Heijne matrix score 5.2402423806254 seq NFILFIFIPGVFS/LK
agaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacggatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtcatcaaaaaaaaaaaaaaa

SEQ ID NO: 17 - DNA, 747 bp, Homo sapiens
  CDS 73..672
  sig_peptide 73..132: Von Heijne matrix score 5.21332530399231 seq SPVFLVFPPEITA/SE
acaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcactttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaatattaaaaaaaaaaaaaaaaaaaaagaaaaaaaaaaaaaaa

SEQ ID NO: 18 - DNA, 1884 bp, Homo sapiens
  CDS 94..1275
  sig_peptide 94..210: Von Heijne matrix score 4.55778392992629 seq LVLVKRLLAVSVS/CI
acagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggattctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttatacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtattgattcactttttacttatgttaaaattataccatttaactggctcttttgtcattgtgctgttattaaaacaatgttcttcaatattttgacataatgtattaacattttaatatataatgtacaatttaagaattggtgctttacctttactatgctttttttacaggacaaaaagactgatttttaaagtatggcattttttgcagcataaataaaatattgttcagtacgaaaaaaaaaaaaaaa

SEQ ID NO: 19 - DNA, 691 bp, Homo sapiens
  CDS 42..515
  sig_peptide 42..92: Von Heijne matrix score 10.7019149919754 seq VLMLLAVLIWTGA/EN
gagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagcgaaaaaaaaaaaaaaa

SEQ ID NO: 20 - DNA, 1138 bp, Homo sapiens
  CDS 271..969
  sig_peptide 271..366: Von Heijne matrix score 5.6680378526706 seq WMGLACFRSLAAS/SP
  misc_feature 989: n=a, g, c or t
aaaaacctttcaagtgccccctcctttccttaaagtcttttataggggtccccttcttggccatctccatcctgtgagtcaggactgaaagggcacagacaggtcactgccagcattgttggggcaagcctgcaagcacgcatcactggggatctgacatgacaatggccgcctgccccctctgagggctacaggacttaccccagtgggaagcagctaagcaggtctgaccagccgacctggacctggccaagggtcctgtcatccctcatggccaccccgccattccggctgataaggaagatgttttccttcaaggtgagcagatggatggggcttgcctgcttccggtccctggcggcatcctctcccagtattcgccagaagaaactaatgcacaagctgcaggaggaaaaggcttttcgcgaagagatgaaaatttttcgtgaaaaaatagaggacttcagggaagagatgtggactttccgaggcaagatccatgctttccggggccagatcctgggtttttgggaagaggagagacctttctgggaagaggagaaaaccttctggaaagaggaaaaatccttctgggaaatggaaaagtctttcagggaggaagagaaaactttctggaaaaagtaccgcactttctggaaggaggataaggccttctggaaagaggacaatgccttatgggaaagagaccggaaccttcttcaggaggacaaggccctgtgggaggaagaaaaggccctgtgggtagaggaaagagccctccttgagggggagaaagccctgtgggaagataaaacgtccctctgggaggaagagaatgccctctgggaggaagagagggccttctggatggagaacaatggccacattgccggagagcagatgctcgaagatgggccccacaacgccaacagagggcagcgcttgctggccttctcccgaggcagggcgtagccagcatgcaggtgcangggccctgtggtccagactcccctgggttgggattcaagtccagggtgagcccatgtgctggagaaaatacacactcattggtctccttgctttgaaagatccaataaagtcctgaggcaaggtttggaaaaccaaaaaaaaaaaaaaa

SEQ ID NO: 21 - DNA, 468 bp, Homo sapiens
  CDS 76..276
  sig_peptide 76..135: Von Heijne matrix score 5.21332530399231 seq SPVFLVFPPEITA/SE
agcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaaaaaaaa

SEQ ID NO: 22 - DNA, 720 bp, Homo sapiens
  CDS 6..287
  sig_peptide 6..80: Von Heijne matrix score 4.17710408129886 seq ISLSHLFLDLSRS/LW
atttgatgtgcttcttagtctcgtttaacttgccgattcatatatccctgtctcatttgttcttagatttgtcacgaagcctctggtttttggcttgtcctggtttgaacttggtgtatctggctcttgactcattttctgacctcagaccatccttaaatctgcttttctactttgtaccaggctttggcgtctccaagtacctgacctcagctcaacctgtcttgggttttcttctcctccctgacattgacaacccagccctcctaggcacagagagatggagctgagtgtggttttcctgaaataaagcttgcattatgagagggaataaacagaagaaaaaaatagtaagtaaaatcttgcttgcctctcagtaaaataaagctctatttttcgttttttttttttccaacttcctgtacaaaaaagggaaaactttagcttttgggggaaatttggagctagcctgttggtactgttgagcttagtgtatctataactatatattattccacaatatcttaaatactttataaagatattttcataaattacagcaatcctggctttagatgattgatggccatttttaaacaattaaagctaatttctagctttttatgagtttggtattaagcacagtagtttcttagaaagtctccagggaatgcattttgcaaaataaaaatcagctaatgacccaaaaaaaaaaaaaaa

SEQ ID NO: 23 - DNA, 727 bp, Homo sapiens
  CDS 171..692
  sig_peptide 171..227: Von Heijne matrix score 4.17573075349936 seq LLLGQRCSLKVSG/QE
attgtgacatcaccgtgcactagccaatggctgcctgcctaagctgggtccctggtctcctgggactactagccctttgttgatagggagaagccaacatctcccgcaggaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccgaaaaaaaaaaaaaaa

SEQ ID NO: 24 - DNA, 470 bp, Homo sapiens
  CDS 137..454
  sig_peptide 137..187: Von Heijne matrix score 10.7019149919754 seq VLMLLAVLIWTGA/EN
atcctgtgaactacccaaaaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtaagaacagtgattgtctgtaaaaaatactgcatgttttgtcagacttttatgcctagtattaaaattgtcttttaaaaaaaaaaaaaaa

SEQ ID NO: 25 - DNA, 987 bp, Homo sapiens
  CDS 238..609
  sig_peptide 238..291: Von Heijne matrix score 10.0374888212272 seq LLLLVMALPPGTT/GV
attccattcacagactcttgttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatggaaaaaaaaaaaaaaa

SEQ ID NO: 26 - DNA, 908 bp, Homo sapiens
  CDS 80..862
  sig_peptide 80..127: Von Heijne matrix score 3.66725851505537 seq FSLLSISGPPISS/SA
gaatgtttatcctctggacaaaccagccagcctctccagagcaggcgtgtgatctctgtacccccgcagtggtcagaatatggagaacttctcactcctcagcatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagactgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccagatggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccaaaaaaaaaaaaaaa

SEQ ID NO: 27 - DNA, 762 bp, Homo sapiens
  CDS 83..310
  sig_peptide 83..157: Von Heijne matrix score 4.72955689475746 seq LCALLSNFCPSTT/VK
ttttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagttgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaa

SEQ ID NO: 28 - DNA, 1102 bp, Homo sapiens
  CDS 310..906
  sig_peptide 310..357: Von Heijne matrix score 11.0931109030915 seq FPLLLLSLGLVLA/EA
atacagtgacctagagcaggcatgggtgggtcacaggctttggagagcactctctgtcctgatcttttcagttgagagacttcagctgttcattgctcatttggacttagttcaaggtcatgtcaaagaagaaggtgcacttacgctagttgttagctctgtcttttgtaaccatcaagttccatgcgattgatcagatttaggagggggcgttgggggataatcaattttgggtgtcaccaggtaaacagagccctcagcatctgaatagaaactgaacaggaacagaagagattcactacatctgagatggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggactagggtcttactaaagaaggacctcttcttgttcattcttgtttaaacctttccttaatatctactctttagcactatagtgaactcctgattatttattctaactggaggagtgaaaaatccaaaattgtggataattcaattaaaagttatgactgaaaaaaaaaaaaaaa

SEQ ID NO: 29 - DNA, 436 bp, Homo sapiens
  CDS 24..287
  sig_peptide 24..131: Von Heijne matrix score 3.79790641648006 seq ILMRDFSPSGIFG/AF
acagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtaaaaaaaaaaaaaaa

SEQ ID NO: 30 - DNA, 1938 bp, Homo sapiens
  CDS 132..1574
  sig_peptide 132..206: Von Heijne matrix score 11.1130239236827 seq LALLLTSTPEALG/AN
ctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgattcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgacagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccctgactggcctgggatatctttacaagcaggcactgtatttttttattcgccatctgatccccatgcctagcagagtgctggcacttagtaggtcctcaataaatatttattaaatgatgacaaaaaaaaaaaaaaaa

SEQ ID NO: 31 - DNA, 1116 bp, Homo sapiens
  CDS 117..545
  sig_peptide 117..245: Von Heijne matrix score 5.65876793443964 seq VVSFALIATLVYA/LF
ataaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgagacatggccacattgcattgtccagaacagcttagaccatgacagttagcatcgaagccacctgaggagggaggcagtaaccttactcctaacagtatttggtgaagatgatcagtctcaggatgttctgagattgcatcaggatattaatgattataaccggagattctcagggcaacccagatctgtaagtaatgctaaagcatgttcaaagttagaggaagacacatttcttctcttttgtaaagtgaggtttaccaacaagtattctttgactatgagaaatcttggccaggcacagtagctaacgcctataatcctagcactttgggaggccaaggcaggtggatcacttgagcccaggagtttgagaccagccttggaaacatgatgaaaccccatctctagaaaaaacaccaaaaaattggacaagagtgttggcacatgcctgtagtccctgcttcttgggaggctgaaatgggaggatcacctgagcccaggaggttgaggctatagtgagccatgatcgcactattgcactcccacctgggtggcagtgagacccttcctcaaaaaacaagaaaagaaaaaaaaaaaaaaaaa

SEQ ID NO: 32 - DNA, 1114 bp, Homo sapiens
  CDS 117..362
ataaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgagacatggccacattgcattgtccagaacagcttagaccatgacagttagcatcgaagccacctgaggagggaggcagtaaccttactcctaacagtatttggtgaagatgatcagtctcaggatgttctgagattgcatcaggatattaatgattataaccggagattctcagggcaacccagatctgtaagtaatgctaaagcatgttcaaagttagaggaagacacatttcttctcttttgtaaagtgaggtttaccaacaagtattctttgactatgagaaatcttggccaggcacagtagctaacgcctataatcctagcactttgggaggccaaggcaggtggatcacttgagcccaggagtttgagaccagccttggaaacatgatgaaaccccatctctagaaaaaacaccaaaaaattggacaagagtgttggcacatgcctgtagtccctgcttcttgggaggctgaaatgggaggatcacctgagcccaggaggttgaggctatagtgagccatgatcgcactattgcactcccacctgggtggcagtgagacccttcctcaaaaaacaagaaaagaaaaaaaaaaaaaaaaa

SEQ ID NO: 33 - DNA, 2072 bp, Homo sapiens
  CDS 144..1262
  sig_peptide 144..224: Von Heijne matrix score 5.14258625256317 seq FLCQRLVLSTLSG/RP
acgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgtgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcagattgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacattaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaggaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgtttttatattccaggtgtgctgtacgttcttattttattttcacaatagctctgtgatgtaagtgctatctccatgagaaaattcataaagggtgttttgttcatttgaaatgtataatgtaaagacattaaatctcctcatttaaggaaaaaaaaaaaaaaaaa

SEQ ID NO: 34 - DNA, 409 bp, Homo sapiens
  CDS 35..316
  sig_peptide 35..109: Von Heijne matrix score 5.38058532480537 seq AVTSLLSPTPATA/LA
tttttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgagttgctccgttgctgcccccctttttccttttctaggttgacctctccttgcccctaagcatggtaataacagttgcatgtattgagtgcttaccaaatggcaagcattgtgccaaaaaaaaaaaaaaaaa

SEQ ID NO: 35 - DNA, 836 bp, Homo sapiens
  CDS 177..767
  sig_peptide 177..236: Von Heijne matrix score 6.51720597568932 seq LAVILTLLGLAIL/AI
aatctgctccacgcaatttctcagtgatcctctgcatctctgcctacaagggcctccctgacacccaagttcatattgctcagaaacagtgaacttgagtttttcattttaccttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgtatatctccagatacagttcagaacaaagtgctagacttctggactatgaggatggtagaggatcccgacatgcatattcaacacaaagtgagagatccaaaagagattacacaccatcaaccaactctctagcactgtctcgatcaagtattgctttacctcaaggatccatgagtagtataaaatgtttacaaacaactgaagaacctccttccagaactgcaggagccatgatgcaattcacagcccctattcccggagctacaggacctatcaagctctctcaaaaaaccattgtgcaaactctaggacctattgtacaatatcctggatccaatgggaggataaacataagccagctcacctcagaggatctcactggggctaaaggaagggtcacatctggtccacagttccctaatagccaccatgtgccagagaatctacatggatacatgaattccctttcccttttctcccctgcttgactccctctcccttatgtgtaaacaatttaaaaatatgatagtgtataaatgaaaaaaaaaaaaaaa

SEQ ID NO: 36 - DNA, 1323 bp, Homo sapiens
  CDS 208..1239
  sig_peptide 208..294: Von Heijne matrix score 5.73027134157378 seq GLVLICVCSKTHS/LK
agtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaaaaaaaaaaaaaaaaa

SEQ ID NO: 37 - DNA, 1945 bp, Homo sapiens
  CDS 60..1682
  sig_peptide 60..143: Von Heijne matrix score 3.75144398608723 seq SGLLLQVLFRLIT/FV
atcgcgactaaacggagtggcggcggcatttcctggtgtctgagcctggcgcggaggctatgggcagccaggaggtgctgggccacgcggcccggctgtcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagaccgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcaaaaaaaaaaaaaaaaa

SEQ ID NO: 38 - DNA, 1330 bp, Homo sapiens
  CDS 198..998
  sig_peptide 198..269: Von Heijne matrix score 9.08017839002281 seq LLLGPGLLATVRA/EC
agaaatcagccctttgcagagggcgcagagggcctggaaacctctgggaccttttcccaggaactgtttatggtttccccctaggtctaggagacgtagatgcataggtggattggatacatcgatggtagctataagagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagatcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcaaaaaaaaaaaaaaaa

SEQ ID NO: 39 - DNA, 2124 bp, Homo sapiens
  CDS 505..1590
  sig_peptide 505..624: Von Heijne matrix score 8.5056444915604 seq VVMLMLLTLLVLG/MV
cctggcataactgataggcatgtatgggaggaccacattcctggggacagcctgggtatgtgacatggcaggtgaccaggttcccatgaatgcccgaggctgtgcccatcccatgagctggggcttccctggaggtaaagagctagggtggggtggcagtgggtagaaccccagctggacagctccttccttagctctgtgattgctacagctggttctggaagccacaggcgccctcaggacaaatggggcttcttcagcacagggtagtgagtgctgagctaagcaaggacactgtccccttctctgcccaggctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctatctggtgaagaccttcactgcagctgtgcgggcagagctgatccgggcctttgggctggacagactgccgctgcccgtctccggtttcccccaggcatctaggaagacccagcaccagtgacctccagctgggggtgggaagaaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccaggcaaaaaaaaaaaaaaaaa

SEQ ID NO: 40 - DNA, 1159 bp, Homo sapiens
  CDS 84..326
  sig_peptide 84..146: Von Heijne matrix score 6.39000252120129 seq LGLSVLLTAATVA/GV
agtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaaagtggagggagagacgctcctgatcgtcgaatyccgaggatcaggkcatcagtggacttatcgcacgaccagagtggggattccctcaacagtgatgaaggagacgtgtcttggatggaggagcagctgtcctacttctgtgacaagtgccaaaaatggataccagccagtaaggagcttctcaattcctttgatttgtcaattcctgtgtgaaggtttgtttttccaacctgtgaaagaaacgtgaatgtaaaagagacctaaataaaaggataattatatttattctctagttgatcagctataaatttatataaaacataggcatgtttgtactaatgaaacgtactgtcaacctctatcacattgttaaattaacacttttggtggtaactcaataaaattgagaaaattgcaaaaaaaaaaaaaaaaaa

SEQ ID NO: 41 - DNA, 1953 bp, Homo sapiens
  CDS 56..1678
  sig_peptide 56..139: Von Heijne matrix score 3.75144398608723 seq SGLLLQVLFRLIT/FV
agactaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatcaacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacgtgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtgaaaaaaaaaaaaaaaaaa

SEQ ID NO: 42 - DNA, 1688 bp, Homo sapiens
  CDS 119..1522
  sig_peptide 119..181: Von Heijne matrix score 11.6921972463885 seq LLLCLALSGAAET/KP
aaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgtttcctggtgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacgtgcaggtctctggagggggacctagcatctccttggtgatgaagactcccagggtcgccaagaatgaggtgctctggcacccaacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaataaaaaaaaaaaaaaaaaa

SEQ ID NO: 43 - DNA, 1942 bp, Homo sapiens
  CDS 334..1551
  sig_peptide 334..426: Von Heijne matrix score 4.0554926521937 seq TVFLLVTLQALDT/VE
gctcatagggagaaaggaagctgcgctgcgttctgcgggacgaaccctgctccgcgcgagaatttttttgattccttcttatttggagaaatctccagctgctctgatcatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggccttggataccgttgagaatctaatgaaagtcacgggccctccccagggagttacagactccatgcaatgcttcaatgatcagtggcctttatctaacaccaggagcagcgagcacataaaagaggtcatggttgagctggggaagtttgaaaggaaggagtttaaaagttccagtttgcaagatggacatacaaaaatggaggaagcacctacgcatcttaattcatttcttaagaaagaaggattgaccttcaacaggaaaagaaaatgggaattggacagctaccccattatgctctggtggtccccgctgacgggggagactgggaggttaggccaatgtggagcagatgcttgtttcttcaccatcaaccggacctacctccatcatcacatgaccaaagcattcctcttctatggtactgactttaacatagatagcttacctctgcctcggaaagcccatcatgactgggctgtttttcatgaagagtccccgaaaaacaattataagctctttcataaaccagtgatcaccttgttcaactacactgccacgttcagcaggcattcccacttgccactaactacccaatacttggagagcattgaagtcctgaagtcactccgatacctagttcctttgcagtccaaaaacaagcttagaaaaagacttgctccgctggtgtatgtacagtcatactgtgacccaccatcagacagggacagctatgttcgcgagctgatgacttacatcgaggtcgattcctatggtgaatgtttacgaaacaaagacctccctcagcagctgaaaaatccagcctctatggatgccgatggcttttataggatcattgcacagtataagtttatcctagcttttgagaatgcagtttgtgatgactacatcactgagaagttctggaggccactgaaactgggggtagtccctgtatattacggatcccccagcatcacagactggcttccaagtaacaaaagtgctattcttgtatcagaattttctcaccccagggaactggcaagttacatcagacgactggattctgatgacagattgtatgaggcctatgtagaatggaagctgaagggtagatctctaaccagcgacttctgacagctctcagggaacggaaatggggagtgcaagacgtcaaccaggacaattacatcgatgcatttgagtgtatggtgtgcaccaaggtgtgggctaatatcaggcttcaggaaaagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagaaaaaaaaaaaaaaaaaa

SEQ ID NO: 44 - DNA, 1657 bp, Homo sapiens
  CDS 72..986
  sig_peptide 72..149: Von Heijne matrix score 6.33091407142367 seq GVGLVTLLGLAVG/SY
ctccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattaaaaaaaaaaaaaaaaaa

SEQ ID NO: 45 - DNA, 1733 bp, Homo sapiens
  CDS 157..1482
  sig_peptide 157..219: Von Heijne matrix score 11.6921972463885 seq LLLCLALSGAAET/KP
aaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagttgcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacstagcatctccttggtgatgaagactcccagggtcaccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctaggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacaaaaaaaaaaaaaaaaaa

SEQ ID NO: 46 - DNA, 1871 bp, Homo sapiens
  CDS 195..1052
  sig_peptide 195..338: Von Heijne matrix score 3.50178852790004 seq LGVFVVCHQLSSS/LN
agtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagtttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacggagcaacactctctcgcaaaaaaaaaaaaaaaaaa

SEQ ID NO: 47 - DNA, 1523 bp, Homo sapiens
  CDS 217..1410
  sig_peptide 217..279: Von Heijne matrix score 5.8172934575094 seq ALLWAQEVGQVLA/GR
acttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacacccctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcgaaaaaaaaaaaaaaaaa

SEQ ID NO: 48 - DNA, 832 bp, Homo sapiens
  CDS 103..492
  sig_peptide 103..162: Von Heijne matrix score 8.21832452871462 seq LFFCYLLLFTCSG/VE
gtttactcgctgctgtgcccatctatcagcaggctccgggctgaagattgcttctcttctctcctccaaggtctagtgacggagcccgcgcgcggcgccaccatgcggcagaaggcggtatcgcttttcttctgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgccttttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaagcaaaaaaaaaaaaaaaaaa

SEQ ID NO: 49 - DNA, 831 bp, Homo sapiens
  CDS 234..491
  sig_peptide 234..293: Von Heijne matrix score 4.85037394589162 seq AVAGLPALGFTGA/GI
gtttactcgctgctgtgcccatctatcagcaggctccgggctgaagattgcttctcttctctcctccaaggtctagtgacggagcccgcgcgcggcgccaccatgcggcagaaggcggtatcgcttttctctgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgccttttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaagcaaaaaaaaaaaaaaaaaa

SEQ ID NO: 50 - DNA, 917 bp, Homo sapiens
  CDS 180..800
  sig_peptide 180..248: Von Heijne matrix score 14.6828672385356 seq ILLLLWLIAPSRA/CT
acccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccttcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcaaaaaaaaaaaaaaaaa

SEQ ID NO: 51 - DNA, 621 bp, Homo sapiens
  CDS 140..472
  sig_peptide 140..211: Von Heijne matrix score 8.44884907465122 seq FVVFSLFLICAMA/GD
atttttttttcatatctgacatttctatgtcctatgacggtttcacagctatcctactttggagaagatgctggaaattcagagtttccgccagagaatatatgcctgaactaaaagaggaagtggtctataggagaaaatgaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagttaattttttgtctacaaacttggcaaaagtctgtgaaaagaagtttcaacttcatgtgttattaactatacaaatattagttgaatgaattgttgaattacaaaaaaaaaaaaaaaaa

SEQ ID NO: 52 - DNA, 673 bp, Homo sapiens
  CDS 68..484
  sig_peptide 68..112: Von Heijne matrix score 4.93618539864455 seq AVVFVFSLLDCCA/LI
ctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacacgaaaaaaaaaaaaaaaaa

SEQ ID NO: 53 - DNA, 897 bp, Homo sapiens
  CDS 38..517
  sig_peptide 38..118: Von Heijne matrix score 7.20400999800742 seq VLWLSGLSEPGAA/RQ
agattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattcttataaaaaaaaaaaaa

SEQ ID NO: 54 - DNA, 1101 bp, Homo sapiens
  CDS 92..634
  sig_peptide 92..139: Von Heijne matrix score 7.36306712986597 seq FLLLTCLFITGTS/VS
cttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcgtgagtaccttccctgtgctctttttctccaccaacaaggccacaggtggagtccaaaagtgcccaattataggatatgcagttacagtggcaactatatctcaatctgaacaacattgatgtggggctaaagatactctgatttctgagatctcttcttagaacttctgaaaaattcctgaagaaatagaaggggaaaggagctatgactttgatcagttctttttaattttgtctgaattccattcaaacaaaacattagaaaatgaaacattgggccaggcgcagtggctcatgcctgtaatcccagcactttgggaggctgaggcgggtggatcacaagatcaggagtttaagaccagcctggccaatatggtgaaaccctgtctctactagaaatacaaaaattagacaggcgtggtggcaggcaactgtaaccccagctacccgggaggctgaggcaggagaattgcttgaacccgggaggtggacgttgcggtcaggcgaaaatcgtgccattgcactccagcctgggtgacagagtgagactctgattcaaaaaaaaaaaaaaaaa

SEQ ID NO: 55 - DNA, 1047 bp, Homo sapiens
  CDS 27..767
  sig_peptide 27..80: Von Heijne matrix score 8.96664802487992 seq LFCLAVLAASSFS/KA
agcagaggccctacacccaccgaggcatggggctccctgggctgttctgcttggccgtgctggctgccagcagcttctccaaggcacgggaggaagaaattacccctgtggtctccattgcctacaaagtcctggaagttttccccaaaggccgctgggtgctcataacctgctgtgcaccccagccaccaccgcccatcacctattccctctgtggaaccaagaacatcaaggtggccaagaaggtggtgaagacccacgagccggcctccttcaacctcaacgtcacactcaagtccagtccagacctgctcacctacttctgccgggcgtcctccacctcaggtgcccatgtggacagtgccaggctacagatgcactgggagctgtggtccaagccagtgtctgagctgcgggccaacttcactctgcaggacagaggggcaggccccagggtggagatgatctgccaggcgtcctcgggcagcccacctatcaccaacagcctgatcgggaaggatgggcaggtccacctgcagcagagaccatgccacaggcagcctgccaacttctccttcctgccgagccagacatcggactggttctggtgccaggctgcaaacaacgccaatgtccagcacagcgccctcacagtggtgcccccaggagggttgcccagggcacccaccatcgtgctggttggcagccttgcctccactgcggccatcacctccaggatgctgggctggaccacgtgggccaggtggtgaccagaagatggaggactggcagggtcccctggagagccccatccttgccttgccgctctacaggagcacccgccgtctgagtgaagaggagtttggggggttcaggatagggaatggggaggtcagaggacgcaaagcagcagccatgtagaatgaaccgtccagagagccaagcacggcagaggactgcaggccatcagcgtgcactgttcgtatttggagttcatgcaaaatgagtgtgttttagctgctcttgccacaaaaaaaaaaaaaaaaa

SEQ ID NO: 56 - DNA, 925 bp, Homo sapiens
  CDS 4..399
  sig_peptide 4..126: Von Heijne matrix score 4.34454795165846 seq RVVSWLFSIVVFG/SI
acgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggagcagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccgggccataggaggcggctgccacccttcttcccatgtttcagatgagggaaatgagccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcttcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagtaaaaaaaaaaaaaaaaa

SEQ ID NO: 57 - DNA, 1240 bp, Homo sapiens
  CDS 127..879
  sig_peptide 127..198: Von Heijne matrix score 5.38660866264012 seq ALCSVCSMSVLRA/YP
agtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctggaagggcaccctctttaacccatccctcagcaaacgcagctcttcccaaggaccaggtcccttgacgttccgaggatgggaaaggtgacaggggcatgtatggaatttgctgcttctctggggtcccttccacaggaggtcctgtgagaaccaacctttgaggcccaagtcatggggtttcaccgccttcctcactccatatagaacacctttcccaataggaaaccccaacaggtaaactagaaatttccccttcatgaaggtagagagaaggggtctctcccaacatatttctcttccttgtgcctctcctctttatcacttttaagcatgaaaaaaaaaaaaaaaaa

SEQ ID NO: 58 - DNA, 902 bp, Homo sapiens
  CDS 156..566
  sig_peptide 156..221: Von Heijne matrix score 5.67458379966095 seq LVSMAGRVCLCQG/SA
atttcccagcgtgcctcaggaagggcgccaggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgccaggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactaaaaaaaaaaaaaaa

SEQ ID NO: 59 - DNA, 1969 bp, Homo sapiens
  CDS 35..1657
  sig_peptide 35..118: Von Heijne matrix score 3.75144398608723 seq SGLLLQVLFRLIT/FV
atttttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttaacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgatcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgaaaaaaaaaaaaaaa

SEQ ID NO: 60 - DNA, 1132 bp, Homo sapiens
  CDS 77..937
  sig_peptide 77..127: Von Heijne matrix score 3.74817238048175 seq RIVSAALLAFVQT/HL
gttggtggggctgggggatgagagctgcaccgcgcgggacaagtcgccggcggcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaaaaaaaaaaaaaaa

SEQ ID NO: 61 - DNA, 631 bp, Homo sapiens
  CDS 9..503
  sig_peptide 9..113: Von Heijne matrix score 10.2506494380376 seq LLPLVLLPPLAAA/AA
tgccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaattacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgcaaaaaaaaaaaaaaaaa

SEQ ID NO: 62 - DNA, 722 bp, Homo sapiens
  CDS 21..464
  sig_peptide 21..95: Von Heijne matrix score 5.38058532480537 seq AVTSLLSPTPATA/LA
ggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacaaaaaaaaaaaaaaaaaaaaaaaaaaaaaaa

SEQ ID NO: 63 - DNA, 1442 bp, Homo sapiens
  CDS 178..1050
  sig_peptide 178..279: Von Heijne matrix score 10.0571391689271 seq FLCLLSALLLTEG/KK
agtgcattgctggagcgaggagaagctcacgaatcagctgcaggtctctgttttgaaaaagcagagatacagaggcagaggaaaagggcactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcagaaaaaaaaaaaaaaaaa

SEQ ID NO: 64 - DNA, 795 bp, Homo sapiens
  CDS 32..274
  sig_peptide 32..178: Von Heijne matrix score 4.30837886795471 seq LMVELLKVFVVEA/AV
gttccggtgggcgcgcgttgaggctgcggtcatggagggagcaggagctggatccggcttccggaaggagctggtgagcaggctgctgcacctgcacttcaaggatgacaagaccaaagtgagcggggacgcgctgcagctcatggtggagttgctgaaggtcttcgttgtggaagcagcagtccgcggcgtgcggcaggcccaggcagaagacgcgctccgtgtggacgtggaccagctggagaaggtgcttccgcagctgctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctctcaaaaaaaaaaaaaaaaa

SEQ ID NO: 65 - DNA, 1236 bp, Homo sapiens
  CDS 222..920
  sig_peptide 222..311: Von Heijne matrix score 4.35083245061594 seq VAHALSLPAESYG/ND
accgaaaattactgacgagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctcaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattaaaacaaaaaaaaaaaaaaaaa

SEQ ID NO: 66 - DNA, 881 bp, Homo sapiens
  CDS 101..355
  sig_peptide 101..160: Von Heijne matrix score 9.32665652007071 seq LFLCYLLLFTCSG/VE
ttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagkggctattcacagatgcgaacatagtacactgcagcctccaactcctagcctcaagtgatcctcctgtctcaacctcccaagtaggattacaagcatgcgccgacgatgcccaraatccaraactttgtctatcactctccccaacaacctagatgtgaaaacagaataaacttcacccagaaaaaaaaaaammacaaraaaaaaaaaaaaaaaaaaaaaaaaaaaaamaaaaaaaaaarrraaaaaaaaaaaaaaagaaaaaaaaaaaaaaaaa

SEQ ID NO: 67 - DNA, 524 bp, Homo sapiens
  CDS 173..487
  sig_peptide 173..301: Von Heijne matrix score 4.27484469223909 seq AGSLVATLQSVGA/AG
agggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgcaaaaaaaaaaaaaaaaa

SEQ ID NO: 68 - DNA, 1472 bp, Homo sapiens
  CDS 210..1082
  sig_peptide 210..311: Von Heijne matrix score 10.0571391689271 seq FLCLLSALLLTEG/KK
acagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctgtttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggatttcgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttcttacaaaaaaaaaaaaaaaaa

SEQ ID NO: 69 - DNA, 1737 bp, Homo sapiens
  CDS 172..1449
  sig_peptide 172..255: Von Heijne matrix score 5.94825670923113 seq XVLLEPFVHQVGG/HS
aaacaataggacggaaacgccgaggaacccggctgaggcggcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcgatgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgaaaaaaaaaaaaaaaaa

SEQ ID NO: 70 - DNA, 1637 bp, Homo sapiens
  CDS 30..1427
  sig_peptide 30..77: Von Heijne matrix score 3.71064775937629 seq YAAAAGVLAGVES/RQ
ctaatcgaaaagtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcaggcttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttacctgcaaaaataaaatgcagaacgtactctacgacaaaaaaaaaaaaaaaaa

SEQ ID NO: 71 - DNA, 1636 bp, Homo sapiens
  CDS 30..1175
  sig_peptide 30..77: Von Heijne matrix score 3.71064775937629 seq YAAAAGVLAGVES/RQ
ctaatcgaaaagtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagcttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttacctgcaaaaataaaatgcagaacgtactctacgacaaaaaaaaaaaaaaaaa

SEQ ID NO: 72 - DNA, 1758 bp, Homo sapiens
  CDS 66..839
  sig_peptide 66..173: Von Heijne matrix score 4.89555877630516 seq LLLLRLNDAALRA/LQ
agaggaggtggcggtggtggccctcgcctgtggcccccgtgctgcttgcactcgaactcgtcgccatggaggagctccaggagcctctgagaggagagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgcccccccctacaaggcctgaccaatcaggatttacaagagggagaagattgggagcaagaagatgaggacatggaccccagattagaacacaattcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataacgggaaagggcctgggtgttacccatgtactgaaaatgaacttttaccaacatggccaaaaaaaaaaaaaaaaa

SEQ ID NO: 73 - DNA, 1647 bp, Homo sapiens
  CDS 64..903
  sig_peptide 64..162: Von Heijne matrix score 10.6748773272319 seq LLLLPFLPLLLLA/AP
agctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagccccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttcggaagtgagaaaccatgtttttaacttgtggctgctcttgctgctgctgctcctccgtatctggctgtatgggtggagaacccacccactgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcaaaaaaaaaaaaaaaaa

SEQ ID NO: 74 - DNA, 1646 bp, Homo sapiens
  CDS 64..585
  sig_peptide 64..162: Von Heijne matrix score 10.6748773272319 seq LLLLPFLPLLLLA/AP
agctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttcggaagtgagaaaccatgtttttaacttgtggctgctcttgctgctgctgctcctccgtatctggctgtatgggtggagaacccacccactgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcaaaaaaaaaaaaaaaaa

SEQ ID NO: 75 - DNA, 1963 bp, Homo sapiens
  CDS 274..753
  sig_peptide 274..324: Von Heijne matrix score 4.4969823290892 seq FAAFCYMLSLVLC/AA
cttcttcgatttgcggacggttccctccagcgactctcgacacacgttttcctgtcttcgccggagggccgggtctggggtcgccggagcctgcgggaatccagcgcttattcgctaaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacataattgcctttgatgagttaaggacagattttaagagccccatagaccagtgcaatcctgttcatgcgagggaacggttgaggaacatcgagcgcatctgcttccttctgcgaaagctggtgctgccagaatactccatccatagcctcttctgcattatgttcctgtgtgcgcaagagtggctcacgctggggctgaatgtccctctacttttctatcacttctggaggtatttccactgtccagcagatagctcagaactagcctacgacccaccggtggtcatgaatcccgacactttgagttactgtcagaaggaggcctggtgtaagctggccttctatctcctctccttcttctactacctttactgcatgatctacactttagtgagctcttaacgcaaagaccatgcacatcatcagagactgagatgggagaggcctgagacggagaggtgcatttctgctggtgactggaggagggaccagaatgaggatacgtgagaaatagacccggcaggcagtcagactgaatgggagctggaatcacgcagcagttgggagccgagttaaccctgcgtgtctgtgtcaccctgtttgtcaatctttggcattcgaattccacacacggggtcctagagcccttctgagcatcagtggtgtgggggagtaggtgacgaaacactagacctctcctgagagagaattgctgcttcctgaatccacttcattgaacagcaccttgcaagttcaaatgagttcctgggagcggaggctggaaggccacaaggtgcttgctaaggaacagaatgacccagagtcaaggccaagtctgcagggacctgttgaaagcctcgagaatgtcttggctgcccaagactcttgttgcctttcttccaagccatggccatgccctttttctcaaatgggaggggctggagggtgtgtgggatttgtcttcagctgcaaccagccttgagcctgctgggctattttcagctgaggaggggtaatataggaaaaatgcatttttgaaacgtttgcaacatgatcaaggtgttagttctccaccacacaagttgtattcttcttttgccacctcaaaccatcacagagtctttaaatgcaaatcaattggtcaatgctagtcaaagctatgttcttacaaaaaccccagacagctcagagctcagaaaatcctgtggagtggctgctctgtaccgtgggcatccggcagccaggaagtgagacaacataattataactttgttttatgatgctgcatcatttgtactgtttaggtcgacgtgaggacatcatcttatttagaattttccgtttggcattctcttttgggtgggagttatgctgggggttgtaaataatgacaaggctgagatttttatgatgtttaaattgggcacaatgattttgaccttattccccaaacttcttttcttttctactgtttaacatacacaggctatttatacacgtccccagctcccatctgaaacctgtgactcaggtttatgaatggtgtttgtgtagcaacacattgtgtgctatgtttattaaaatgcagcgacaaaaaaaaaaaaaaaaa

SEQ ID NO: 76 - DNA, 1757 bp, Homo sapiens
  CDS 191..1468
  sig_peptide 191..274: Von Heijne matrix score 4.02941490119842 seq GXLLEPFVHQVGG/HS
cattttggtgcgagagaaacaataggacggaaacgccgaggaacccggctgaggcggcagcagagcatcctggccagaacaagccaaggagccaagacgagagggacacactgacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctcccttctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgtaaaaaaaaaaaaaaaaa

SEQ ID NO: 77 - DNA, 2027 bp, Homo sapiens
  CDS 48..950
  sig_peptide 48..107: Von Heijne matrix score 6.64507667657896 seq LLPLLSLLVGAWL/KL
atgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggattgagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattcttttttttttttttttttttttggagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaaaaaaaaaaaaaaaa

SEQ ID NO: 78 - DNA, 1880 bp, Homo sapiens
  CDS 156..512
  sig_peptide 156..206: Von Heijne matrix score 3.55618791452243 seq WLTAVASLLPSPG/NS
atatacaggtggcagctctcgtcccctgagagcgggcgaaggccagggtcccacactcgcagcgctgcgacggcgctcgggacctccctcgtccactgcttgagttccagaggtgggtgcttccctgtcctgaacttcagagtgcggagtcataaatgggttccggctggcttactgcagtagcctcgctcctccccagccccggtaactccgagctacccgtccaggccctcgggcgtcgcgggggcagggactgggcgcggaacgaggcagggagggacctggaaaaaccacccagattgcattgcagtgggcgaggccgcctggaggagccggttccccctaaccacctccccgtggggctctcggtgcgcggttcccaggtgctcagctctgctgggcccaggaggtgccgcctcacagggacgcggaaccccgtgcgtggcccccgccgggtggaacagatagcgcggggcggtccggaggctcgtcgccaagcaggtgactcttgctgaaaaagtggttggaacacttaaggaaacccggccccgcctgttctttctaggtctttggagtttggattaatcatttgtgtagcccgtttggataaaccgaagactttattaaatcagcgcgtttaacaggaattccgcagtagtatccacattagaatcttgagtcttggagttgaacatattcacacagacttgccttcttcctgtttagtttatgccttgtgttccgttattggaacgctaagcttgtgggagttgtttacatcctactgctcaaggtcatcgctaaggtgtgatttttcacaaaaagaatttgcaacctccggcatgaatgacttaagggaagtctaatcccggtttctgatttttttttttttttaatttaaaagttaatctttctgggccgggcgcggtggctcacgcctgtaatcccagcactttgggaggccgaggcggatcacgaggtcaggagttcgagaccagcctgaccaacatggtgaaaccccgtctctactaaaaacacaaaaattagccgggcggggtggcgcgcacctgtaatcccagctgctcgggaggctgaggcaggagaatcgcttgaacctgggaggcggggggttgcagtgagccgagatctggccattgcactccagcgtgggcaacagagtgagactccatctcaaaaaaaaaggttaatctttccaactagattttcaaggatgaggattttgttgttgttgttgttgttgttctcaaatgtattcccagggcttggaacagagcctgacatatactaggcactcaacaaatatttgttgaatgattgtaatgagtaacacccatttttgcagatctttgtcttctgagcctagggcataggtcatcactgcaggggtgagattgtcaaaatgggagtctacaggtaatttaagacttaaatgtttaaagagtatgtgctcattcttcaacaaacttacttttgttaaattaaaatggtaaaatgtggtggaggggttggaatatatgtaattcaagacagttctgaatacaaaaatgttttactgtctatcaccaccatctataaatctaattcactaaggataatctgtgtaaggtggctggaaagaaccttgaggagagaggcttatttaagtattggctcaggaccacacctaaaattctcaaaacgttgagattctgttgttttgtttttaagcgccagagacccaagttgaggaacagcctataaaataactggcctgtactcttacatacatgaaagccatcaaagacaaagactgaagaagaacttttgcagattaaaggactttaagagacatgatcctgaaccaaaaaaaaaaaaaaaaa

SEQ ID NO: 79 - DNA, 584 bp, Homo sapiens
  CDS 67..351
  sig_peptide 67..183: Von Heijne matrix score 10.6473524146908 seq FLCALCSFCPISA/AS
ctgattcttcgaaatgatataagtcctgagggcttcagtcccattcgcgcactcatacttgcaatcatggactacagccgtgtctttcagggtgtgttcttcaccttcaagcatgcttttgctgatggtgcttgggatctttcatttctctgtgctctttgcagtttctgcccaatctcagctgcctctggcagaccttacaggtacttggaattctggagattatacctgtctcctagttccatggaaaatggagttcaaaaattccacgaaacttttttcattgtctttttgcttttgtttgatatcgagaggaaaggaaaaagttctgtttgtccattttgttacagataaggaaagtggtttcacaaaggttaagcaacttgttcagtgttacccagcaaagagcagaatgattttcaacattcagtttaaaagtcggcggggggcagtggctcacacctgtaatatcagcaacttgggaggccaaggtggtacggtcgcttgaagccaaggagttcaagaccagcctggtcaacatagcaaaaccttgtctttacaaaaagtaaaaaaaaaaaaaaaaa

SEQ ID NO: 80 - DNA, 1351 bp, Homo sapiens
  CDS 259..831
  sig_peptide 259..375: Von Heijne matrix score 5.809301698725 seq FCVCVIAIGVVQA/LI
aagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccatcggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcccctcctgctccctttggctggctgttgcttccttccagcgtctgctcctccgcggcctcatctgcctcttcgtctgttagagcgcgcgtctcgtctcagtcgtcacgtttttggtttttgtggggtttttttttttttttttttttgagacagtcctgctgtgtcgcccaggctggagtatagtggctcaagctcagctcactgcaacctccgcctcccaggttcaagcaattctcctgcctcagcctcccaagtagttgggattacaagcacccaccaccatgcccagctaactttttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctcgagtccaagtctcctgatgctctcaaaaaaaaaaaaaaa

SEQ ID NO: 81 - DNA, 720 bp, Homo sapiens
  CDS 111..377
  sig_peptide 111..233: Von Heijne matrix score 5.26415334394122 seq LWFLAQIPSRVAG/SL
aaaccgaaaccagcgctccaaacaattgggacccgggatcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaaggtactgtggtttcttgcgcagattcccagtagggtcgccggtagtcttctttctgtctgtgtgatgagcagagatggtaacataaaggactctggtgaagacactcagtcgggtaccagggaagtctgttttctgcctgcctccctatctccatattcaagtcggctaacgtttcagaggcgtttttgagcagaggaaagtagagttctagtctagaggaacaaggggctctggcagctcaaatcaattaaccaagatccaattccctggagaatttttaacccctcccactccacccatcacttgcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaaaaaaaaaaaaaaa

SEQ ID NO: 82 - DNA, 1029 bp, Homo sapiens
  CDS 223..432
  sig_peptide 223..336: Von Heijne matrix score 4.17665217008018 seq LVNVLFFFTPLMT/LV
gtttttgtattggaagcagttgtttggccttgctgagcaaacgtctatgccttctccattacatccaaaggagaatagccccatgtgaagaatggaatcagtagatgtttggtcgctgtaccatatccactcctaggatacaacaagagcaagcccaattctcttggtggtgtgggcagtcggcttgcaccacgtacctatctcagctctttttggaagcttatgtcctccccacaacttccagctttcttatgggacaagggtacactcaccactgccatatctaatcctgcttgcctggtaaatgttctcttcttctttacacccctgatgactctggtcactctactcatcctggtctggaaagtaaccaaagacaaaagcaacaagaacagagagacacacccaagaaaggaggcaacatggctgccataaagatctggatctcttggtggggactccactgaggtgaagacctgattgtacaagagaggcacggccactggagctgtctcagagcccagagccaggggagccagagctgctttagccaccctgttcctccattgccagatgtccccccaggcctcatttccttcctctgccaccatccctcttataatgcactcctcctgcggttctttggcttgtcccagcttctgagtttgaatgtctttttttttttttttttttttttgkggatcttcaagactgaaatagtaaatggctcttgatttctgcactaacagaggaaagaaacaagtacatggaaaagtaaaaattgattacaaagcctaaattttcctctataaattgggcatgtgctgactgtgggatattgaaattattgggagctcacagcatctcaagttatataatgaagctattctggaagctcatttccagaagatccttaaaatgaaatggctcactctctgctgaattaatttggagcaagttaactcctttttcaaatgaaatccaaattaaagaggcagttttttttgaaaaaccaaaaaaaaaaaaaaa

SEQ ID NO: 83 - DNA, 1788 bp, Homo sapiens
  CDS 769..1272
  sig_peptide 769..843: Von Heijne matrix score 5.65786415517206 seq AAHLLVVILPANA/AL
ttgggcagaaaaattcaagcaggagattgtatttcttttggagttgtacgatttcctttattatttgaactgcagtaaagaaagctgggatgggctcctctagggatacttccagatccctgggcggttgtagccctggctcctctttaaatggatttggtttcaaagacgatcatctccgtcttctcggatgtcatagtgccactgatcatctccagctcctggccaccctgggctttctccactttggcctctatgttttgcttctccaccgtcttagccacgatatctacctctctgtcatgtgatgtgacccttgtttttgaaccaggagtggccctgaggctccttaaaaaagagctgatcttactggctttcttttgtaaagctcctgtgctagatgcagattggttcttccccagttcctgagttgttctcgactcctttttggtggagctgtgggtggagctcttgcgagaggagccatgtcgcttgccccttacgttgctgtaccctttttcttttttgtcatctctcgtgtttttatggccagatgcggaccggtgggaagacgctttctgattcttgtcccccgctctcctgcggtgactttcacctgccttgcggtgatgagaacttttcctactgggatgtctgtccttcttttctcttctttccttgttttcattccagacttcagcactgggctgggaaactttctggcttccatctcgttcactcatgtagccttcgctttgcaaggtggagatgaggggtcccactgctggtccttcagttctttctgctgcacacttgctggtcgtaatactgcctgcaaacgccgcactcaagctgctgtcttgggagagactggcggcccccgccatcgaggtggaagtaccttccaaggaggtgcttgcagcacccaccaaggccaagctaataccctctgaggatatgttggcagcacctgccatggacttgctggattcattttctcctggatttttgatagctgctcccgccagcgctgtgatcacttggcctgggcctgcagatttggttgttgctatgctcatagcacctgttgcaggactcattgctgcccctgctattgccacatctgttctaggtcctgttgctgttcctgccactgccatgccacctgctgtccttgctgctcctccttcagcagcccctggagtgctcgtggatggagaagccgcactagccgttccgtgggaggcatgttggattccctctcccccagcataagcagaagaggtggctgcagatacatcacaaggcttgtagagcccagtctcactctgatccccttctctgtggagctctgcagcctataccaaggggaagagaaacagatgagattgagatgactgaaagggagatcagaactttctactcctctcttatcctggagttaattcaagggcttataattagaagaacctgggtcgggtgtggtggctcacgcctgtaatcccaacactttgggaggccaaggagggcagatcgcttgaggccaggagttcaagaccagccttgccaacatagcaaaaccccgactctactaaaaatacaaaaaattagctggacaggatggcgcatgcctgtaatcccagctactcagtaggctgaggtaggagtatcgcttgaactcggatggcggaggctgcagtgagccaagactgcgccactccactgcactccagcctgggcaacagagtgagacactgtttaaaaaaaagaaagaaaaaaaaaaaaaaa

SEQ ID NO: 84 - DNA, 805 bp, Homo sapiens
  CDS 30..527
  sig_peptide 30..74: Von Heijne matrix score 8.68924532952647 seq PLLIICLLPAIEG/KN
actggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaaatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggagatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcataaaaaaaaaaaaaaaaaaaaaaaaaaaaaaaaaataaaaaaaaaaaaaaa

SEQ ID NO: 85 - DNA, 814 bp, Homo sapiens
  CDS 39..506
  sig_peptide 39..83: Von Heijne matrix score 5.91494342964539 seq ILMLTFIICGLLT/RV
attcctcaggacacagagcttcctctctcccaggagccatgaatatcctgatgctgaccttcattatctgtgggttgctaactcgggtgaccaaaggtagctttgaaccccaaaaatgttggaagaataatgtaggacattgcagaagacgatgtttagatactgaaaggtacatacttctttgtaggaacaagctatcatgctgcatttctataatatcacatgaatatactcgacgaccagcatttcctgtgattcacctagaggatataacattggattatagtgatgtggactcttttactggttccccagtatctatgttgaatgatctgataacatttgacacaactaaatttggagaaaccatgacacctgagaccaatactcctgagactactatgccaccatccgaggccactactcccgagactactatgccaccatctgagactgctacttccgagactatgccaccaccttctcagacagctcttactcataattaattaacatttacttctggtatggaacaactagaaatactgctggaaataatatccaaagagctgattctaccaatccaatttcaccaggaaaattccatcagggattggatgaccatggggatggacataattgctactaccaacacaacagccaagagagttgccttacaattagaaatgtgtagacagaaatgtatagaagatacaaggattctcttaattggacttaaattctttatctgtcttcctccgatgtactcaaatatatgagctaatttttgtcttaagtgaaaaaaaaaaaaaaa

SEQ ID NO: 86 - DNA, 598 bp, Homo sapiens
  CDS 115..429
  sig_peptide 115..210: Von Heijne matrix score 8.2583062681354 seq LVAAMVLLSVVFC/LY
attctaccagctctggctgagcctgagcttccaaaagtgagctgagctgttcaaccttggatcttaattactcctagcagggataattaggtccctctttctcagattacaggcatggcaaagatgtttgatctcaggacgaagatcatgatcggcatcgaaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattgcaaaaaaaaaaaaaaa

SEQ ID NO: 87 - DNA, 699 bp, Homo sapiens
  CDS 332..574
  sig_peptide 332..412: Von Heijne matrix score 7.96491294552426 seq ILGLFCCLPLAIP/AV
aatcccctgtggttggtgatcaaggaagagcatagtgccagacctaggtgccctcctgggaatgttccaggagggcaggagtaggaggaggagtgttagagtagaggggaaatgatgagagcagaaaggagagtctcgctctgtcacccaggctggagtgcagtggcaggatcttggctcacttcaacctccacctcccgagttctgcctcagcctcccaagtagctgggattacaggtccagtcactccacgcttgcagagtccaattaacaagagcaagttctggtagaaagaaggtgactttattccagagctcaggtgtttgaactgatgtctgatgaggatgaatccagcgactacctctgcctgtccatcctgggcctcttctgttgccttcccctagccatcccagccgtgatcttttcttgcctgacaaagaactacaataaatccagtgactatgagctggcagccaagacctccaaacaagcctactactgggccatcgcgagcatcactgtgggaatcttaggtaccatcttgtacacctacctgatatacttacttagattgtaaactgcttcccagctcttgaacaaaccaccaaatatacaccacagtgcaatttaaaaaaaaaaaaaaaaaaaaaaaaaaaaaaaaaaaaaaaaaaaaaaaaaaaaaaagaaaaaaaaaaaaaa

SEQ ID NO: 88 - DNA, 905 bp, Homo sapiens
  CDS 133..417
  sig_peptide 133..213: Von Heijne matrix score 11.106948594338 seq LTSLLILVTLISA/FV
atttccagggagctgaggagctgagggcagagctagcttttggttatttgggatgttattgccagtttcctcccagggccattgttaccacctgatcatttgagttttagtttctctagcagatgctgactaatgactgaccaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcataatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttacaaaaaaaaaaaaaaa

SEQ ID NO: 89 - DNA, 514 bp, Homo sapiens
  CDS 113..364
  sig_peptide 113..172: Von Heijne matrix score 4.37180298395146 seq SLLLSLPPHQGLT/FS
ttttttacatggtgttcccacagctgggaggacacccacatggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagtcttgcatccggaaccaggactgcgagactggctgctgccaacgtgctccagacaattgcgagtcgcactgccggagaaggggtccgagggcagtctgtgtcaaacgcagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcaaaaaaaaaaaaaaa

SEQ ID NO: 90 - DNA, 518 bp, Homo sapiens
  CDS 9..380
  sig_peptide 9..104: Von Heijne matrix score 4.73369226787171 seq AVFAVLFVFFLFA/ML
acatcctaatggtggtggttgaaccaggagccagtttattcccaaatggtgttccttggctctatgctgtgtttgctgtgctttttgtattttttctttttgccatgttatctccctttttacttgagatagaccagcacataaagaaattcttgatcagatgcaggtattctctgcataacactgtgcataaggacaaaaaaaacagtgagataaagatggaccatctagaaaggccaggctgtccactggagtcaccaaggagaggagttctgggagggaagaaaaatgggatgggaaacgacccattactatttgtgaaagtgacaaaagaacccagggattctgaggctgaaatctatacccctgggccttcagtttgagagtcatttagcctatatggaattacctgtgacattacattccagagagatgagaaattctgagacccttattatcgatgtttatattgaaaaaatggtaataaatattttgagactcccaaaaaaaaaaaaaaa

SEQ ID NO: 91 - DNA, 808 bp, Homo sapiens
  CDS 155..340
  sig_peptide 155..292: Von Heijne matrix score 8.64329745298384 seq AVLLLILFAIVFG/LL
cttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccaccaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgctaaaaaaaaaaaaaaaaaaaaaaaaaaaaaaaaaaaaaaaaaaaaaaaaaaaaaaa

SEQ ID NO: 92 - DNA, 737 bp, Homo sapiens
  CDS 185..634
  sig_peptide 185..253: Von Heijne matrix score 9.49395175807817 seq SLLFICFFGESFC/IC
atattttgctgactggcaaggttatatgaagtgcttttattgaagcaccattttaactaatagctcctggtattttctgcttcccttcgtagggaatttagttattttattttattatttagctaatttagctattttaaaatagctaaattttagctacttttttttcaattgacaaagaaggatgtctaatcaaagactaccgctgattttttctctgttgtttatctgcttcttcggggagagtttctgcatttgtgatggaactgtctggacaaaggttggatgggagattcttccagaagaagtacattattggaaaggttgtttatatctcatttataatttattacaagctgtcttcttcgtcttatttgttttgtctgtgcattacctgtggaagaaatggaagaaacaccaaaaaaagctgaaaaagcaagcctccttagaaaaacctggtaatgatctagaaagcccattgatcaacaacattgaccaaacactccacagagtggcaaccacagcatcagtgatatacaagatctgggagcacaggtctcaccatccttcctctaagaaaattaagcactgcaaattaaagaagaagagtaaagaagaaggagccagaagatactaaataaatgcatatgcaaatgtagcttagtcaattatagatatcacaaaagaaatctatcatctaaggattaaaaattgttctttggaaaaaaaaaaaaaaa

SEQ ID NO: 93 - DNA, 728 bp, Homo sapiens
  CDS 53..646
  sig_peptide 53..91: Von Heijne matrix score 4.95353272042967 seq MLLGRLTSQLLRA/VP
aatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggacccaaaaaaaaaaaaaaa

SEQ ID NO: 94 - DNA, 582 bp, Homo sapiens
  CDS 247..510
  sig_peptide 247..318: Von Heijne matrix score 5.20026065148038 seq FCALEVVLPSCDC/RS
atcatactcaccatggctcacaaactgcctgtttgaaactcccttcagttctgagaggatgggaacattctttaagcggttcgtcttggcacgagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcaaaaaaaaaaaaaaa

SEQ ID NO: 95 - DNA, 1913 bp, Homo sapiens
  CDS 143..592
  sig_peptide 143..277: Von Heijne matrix score 5.94057630118762 seq VLVDLAILGQAYA/FA
atttttttgtgcctaagatgcccagtgcgttgctgggtttttctgctgtcctcgggctctggacatgaggccagaccttgtgaccttgttggcagtgggcagtggcttgatgtgaggtcccagagacggcaggttcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgccccacccccagaagccggcgccccacgccgtgcaccccactggcaccaaggccctctgacagtggggaggacgaggatgtgggaccgccagccgcgggcactggtgggccctgacctccccgcggggagggtgggtgccgtggcccctgcaggtgtggcagagatggggcacgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagtcggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaggcgcagtgactgctgaatgtaccctgtgtggcgacttggaatcaataaaccatttgtggatcctaaaaaaaaaaaaaaaa

SEQ ID NO: 96 - DNA, 670 bp, Homo sapiens
  CDS 33..458
  sig_peptide 33..89: Von Heijne matrix score 6.45239823575329 seq SVFLLMVNGQVES/AQ
aggtgggtccccccggcacccccagacctgccatggcgaccgcgagtcctagcgtctttctactcatggtcaacgggcaggtggagagcgcccagtttccagagtatgatgacttctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggggcagaggaaaaactcttgtcagatgggaaaaatgctcatgacataatgtgacattaaaaggtgggaaacaaaaaaaaaaaaaaaaa

SEQ ID NO: 97 - DNA, 939 bp, Homo sapiens
  CDS 1..336
  sig_peptide 1..81: Von Heijne matrix score 3.68137078794859 seq AHLCSDSLPESQQ/QD
acttccgaagagagaaccgccatgaagagagaagggggtgccgcccacctctgctccgacagcctcccggagtcccagcagcaagacggcaaccacgcacccaacttctccagccacggctcatgccgccgtcgccagcggsccgacatgacaaggcgctgcatgcccgctaggccaggtttcccctcatccccagccccggggtcgtcgcccccgcgctgccatctgagacccggtagtaccgcccatgctgcagcgggaaagagaacagagagtcctggggacaggtaccgtgcagagggcttgagaaggggccgggtcgcgggggcaagggtatgaggggagggctgcagaccgccgctcttccagttcccgccatcctccgcgagctcaggcgttggcatttcggggcctggcaaatccccgccccgcctccgcgcaggggctactgggagttggagtttgcttctctgtagttgggcagctgctcttggtctagtgaccaccagcctggacagctacggagaacccgccttaggtagaaagaaagtgatttttttcctttgcaagagtttgacccgggaccctaactgcttaatgcatatttagatcgttttctgtacgttgtcagttctactgatcctagtggtttagtaatataaaccttttctatgttgtgggtgaaattatgtaacctgtgatgagggaatcccttccacgaattactttgtagtccagcgtgcacgctagttcatacttaaaagaacttgcagatttggaatgtgacgtgttttctctttcagtaacttcacgcctctccaagaggctaatttttttgtaaagattttgtgggagctatgtaatgagatggggagtttcatctaatgacatcctctgacaataaaaaatgtttaaattccccaaaaaaaaaaaaaaaaa

SEQ ID NO: 98 - DNA, 661 bp, Homo sapiens
  CDS 174..443
  sig_peptide 174..269: Von Heijne matrix score 4.13107367257584 seq SSLAFCQVGFLTA/QP
aaaaaggaactttcagtgataatgaacaaaactcaggagctatgtggatgacaggagcacctagatgaccgactttacccacttcaaatgctaccttgaccctagcactctctccaccctgcatcctcacctcagaccatcagttggttaggccaacagctcaccatcaattcatgccctgcctagaccaacagctcactgttcatgccctaccctgccctgcccagccctcctctctggccttctgccaagtggggttcttaacagcacagccttcacctccgagaaggcgcaatgggaaagacagatacacgttggttctgcaacaccaggaatgccaggatgatttagccacctcctcacttgtctacctttccctcccctgcttcaaagacttgggtcgatcgaagcaccaaagcatcactgttgctgacactaacaagtagtgccaagggattgcctttaaggaagatcaggagcggaacatctggtggcaaagaaaatctttctaatagccccattctagtgaccaccttcaacctcctcatagcaggagagtttgggagtaggggacttaggatgttttgttcttttaatcaattcagaaaatatgtatgtttgaaataaaaataaaaatacttgagccaaaaaaaaaaaaaaa

SEQ ID NO: 99 - DNA, 647 bp, Homo sapiens
  CDS 282..521
  sig_peptide 282..386: Von Heijne matrix score 3.64439944832387 seq LEPGLSSSAACNG/KE
acttgcgtgtcaccgttaccgtagcgactgggcttctggactgtatatcctagctgccttgtcaacatcttcgagcatcggcagctccggaggccggggtaactggcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaaaaaaaaaaaaaaaaa

SEQ ID NO: 100 - DNA, 1006 bp, Homo sapiens
  CDS 251..643
  sig_peptide 251..295: Von Heijne matrix score 3.74215118492367 seq LLMFTQLLLCGFL/YV
aggaagccagagggctggaaatacagcagcctttgaagtaccctctgttaatttggatggatctcagtgtgccccgttcgagacctctccaccaacaccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtagcacggtggggccccgtctctacaaaaaatacaaaaaaaaaaaaaaaaa

SEQ ID NO: 101 - DNA, 1059 bp, Homo sapiens
  CDS 179..475
  sig_peptide 179..295: Von Heijne matrix score 4.14109371250204 seq PSLIAGLFVGCLA/GY
gtttttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggtccaaaaaaaaaaaaaaaaaaaaaaaaaaaaaaaaaaaaaaaaaaaaa

SEQ ID NO: 102 - DNA, 514 bp, Homo sapiens
  CDS 34..327
  sig_peptide 34..162: Von Heijne matrix score 5.69273078757386 seq LGDALLFLRPAGS/CA
agagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggagccacacaggacagttgacccaacacttctgccacctgaagaacgacacctgcattcctccatctctgggaccaccaaggaactcagggagcttggaatctctcagatcaaaaagatactgactcatcggatagccatggcatcctgaaaacggccttccttgtgtgtacattatttgcaacaagcaacaagtttataagcactttggtaaaattgcatgtgagggttaaaatattaaagtcagtgcgtcaacttgaaataaatgatgagttattgattactgctaaagaaaaaaaaaaaaaaaaa

SEQ ID NO: 103 - DNA, 1158 bp, Homo sapiens
  CDS 303..953
  sig_peptide 303..359: Von Heijne matrix score 5.47911600153114 seq LCCSGCVPSLCCS/SY
aaaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacgacttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttkttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggtcaaaaaaaaaaaaaaaaa

SEQ ID NO: 104 - DNA, 1563 bp, Homo sapiens
  CDS 97..645
  sig_peptide 97..156: Von Heijne matrix score 8.42885652997473 seq AVVGCLLVPPAEA/NK
  misc_feature 972: n=a, g, c or t
aatagaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggcccasaagggaatggagacattcgaggcggcctcaggagtggatgcgatcttgtctctcctkggcctcccactcttngccgccttccagctctgagtcttgggaatgttgttacccttggaagataaagyctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctctaaaaaaaaaaaaaaaaa

SEQ ID NO: 105 - DNA, 1621 bp, Homo sapiens
  CDS 80..820
  sig_peptide 80..118: Von Heijne matrix score 5.76690322882439 seq MLVLRSALTRALA/SR
acctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcagaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctctctgctaatggtgcttaaattctcccaagaggttctcacttttatttgaaggaggtggtaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttactttatttcggatcctgtttaacaaagatacttgagacatccatttgttttaatgaaatctgtatggatatggaaatgcttgccctaataaaagcctacatatacaaaaaaaaaaaaaaaa

SEQ ID NO: 106 - DNA, 557 bp, Homo sapiens
  CDS 77..388
  sig_peptide 77..217: Von Heijne matrix score 4.57105404339594 seq FLYLTLNQSCIFA/NY
aacaccctccctggaccctctgcctggaggacggggaatcacagcagctggtttggggtgcctcccaaaccaaaagatgttctctccgcgccaagctttgacgcccgaccccctgcactctcccgcctactcaccggtcctagggggttggtcccgctttcgtagtgtggattttcgtttcctctacttgactctaaatcaatcctgtatattcgcaaactacaaagaggcgcatgcaaatagatactgtactgagggcagatacacgcgcgagatccagaggcttacatccccagccgcttggcccaccagagacaagaacaggatgataagcaatggaatggcattgaactctcctgctgaaggacttgcatttcaatgtagattctgaggctgggtgaaaacttctctgtcacctttactacagcattctcacccatttatatttctttccccttctacatctctattactgttgcactatgttatgcattacaccatggcaaaattaatcaattaatacaataaaagcttaattttaaaaaaaaaaaaaaaaa

SEQ ID NO: 107 - DNA, 600 bp, Homo sapiens
  CDS 139..513
  sig_peptide 139..201: Von Heijne matrix score 5.86857787719223 seq IVMGVQVVGRAFA/RA
gaggcaatgcgcatgcccagcgccgtatcgcgcacgctctctgcggctttccttgacctctgacccgccgaccacgcttgatccccggccgcggggccaggaagtcggagtttgagccccggaggcagagcggctgccatggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctacaaaaaaaaaaaaaaaaa

SEQ ID NO: 108 - DNA, 1129 bp, Homo sapiens
  CDS 81..986
  sig_peptide 81..134: Von Heijne matrix score 5.03543461931947 seq ITLLGLAVNVVTT/LV
acagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttgaaaaaaaaaaaaaaaaa

SEQ ID NO: 109 - DNA, 778 bp, Homo sapiens
  CDS 266..586
  sig_peptide 266..307: Von Heijne matrix score 4.534746808071 seq ILVTVPGVCPAQC/CW
tagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacagccgaaggagtaaaggtgctgcaatgatgttagctgtggccactgtggatttttcgcaagaacattaataaactaaaaacttcaaaaaaaaaaaaaaaaa

SEQ ID NO: 110 - DNA, 1301 bp, Homo sapiens
  CDS 59..745
  sig_peptide 59..160: Von Heijne matrix score 5.94384548075359 seq LGAAALALLLANT/DV
attcaaaaccaggctgaagattggaaggaagttggccagcctcggctgcaggacagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggtttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaa

SEQ ID NO: 111 - DNA, 1300 bp, Homo sapiens
  CDS 59..676
  sig_peptide 59..160: Von Heijne matrix score 5.94384548075359 seq LGAAALALLLANT/DV
attcaaaaccaggctgaagattggaaggaagttggccagcctcggctgcaggacagaaatgtctttcctccaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcggaagatgatgtttatgggatttatccgtctgggagtgtggtacaacttcttccgagcctggaacggaggcttctctggaaacctggaaggagaaggcttcatccttgggggagttttcgtggtgggatcaggaagcagggcattcttcttgagcaccgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggtttaaaattgactgccaggctgggtgcagtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtcccagctacccgggaggctgaggcaggagaatcacttgaacctgggaggtggaggttgcggtgagctgagatcacaccactgtattccagcctgggtgactgagactctaactaaaaaaaaaaaaaaaaa

SEQ ID NO: 112 - DNA, 1617 bp, Homo sapiens
  CDS 15..278
  sig_peptide 15..146: Von Heijne matrix score 12.2610572403264 seq PLFLLLLLGSVTA/DI
gagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacattgaacatctcaagcgggagcattcgctcattaagccctaccaaggggtcggttccagctccccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaactttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactggaaacccaggccttcctgttcaccctgagctgcttcctgagacagatgctcaagtgaggctgcaggcgcggtgtggtggggccgagtgtgaccgtttgctaaataaagtgaaatacccaacaaaaaaaaaaaaaaaaaa

SEQ ID NO: 113 - DNA, 1634 bp, Homo sapiens
  CDS 167..619
  sig_peptide 167..262: Von Heijne matrix score 6.8501239662158 seq LLSSCGLPPSTAS/AV
gtacttccgagagagattaaagattcaatggaactctgcgtctctcatctggaacccaggacacagaacaagggagggaagaaaagctcagccttaaacatagcaaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactsgtggtgcaaacctctaccttttttacaaaaagatcttattgttaatttattgtttctggcacttgggcaaaccctgtagttaatactcctccccmacactagacactgggtttcaggaggagggagactgccctgctttggtccccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataggtaaaaaaaaaaaaaaaaaa

SEQ ID NO: 114 - DNA, 693 bp, Homo sapiens
  CDS 223..417
  sig_peptide 223..270: Von Heijne matrix score 4.19788230215007 seq LACVRESTSVAWA/CK
ttagggggcctgtcacccagcacgtgcatcgggggctgtcccgggggtcaggggagggaggccagcgggcmgtgtcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggaaaaaaaaaaaaaaaaa

SEQ ID NO: 115 - DNA, 784 bp, Homo sapiens
  CDS 166..732
  sig_peptide 166..237: Von Heijne matrix score 6.60662787180923 seq KMVHLLVLSGAWG/MQ
attattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgscttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttctccaaaaaaaaaaaaaaaaa

SEQ ID NO: 116 - DNA, 804 bp, Homo sapiens
  CDS 75..623
  sig_peptide 75..215: Von Heijne matrix score 8.34104221735598 seq RLLLPCLVRMALC/AP
agtacggtggccgacgggagtcagacgctggggatgaatgaaggtgctgggtgcaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttagaccgagtcttgccctgttgcccaggctggagtgcggtggcgtgatctcggctcactgcaacctccacctcctgggttcaagtgattcttctgcctcagtctcccgagtagatgggactacaggcacgcgccaccatgcccggcttttttgtattattagtagagacgaggtttcaccatattggccaggctggtctcgaactcccaaccttgtgatccacctgcctcagcctcccaaagtactgggattaccggcgtgagccactgtgcctggcctatgtggtggagtatttattatacgtaggatgtgaatccctgaaatacacaggcaaactaaatagcatttcagaagtaacagaacattttagaacactttatacatccttttatagcttatttcaataaaagataatttttatacaaaaaaaaaaaaaaaaa

SEQ ID NO: 117 - DNA, 484 bp, Homo sapiens
  CDS 30..335
  sig_peptide 30..71: Von Heijne matrix score 4.49063834776683 seq FLTALLWRGRIPG/RQ
gcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacacaaaaaaaaaaaaaaaaa

SEQ ID NO: 118 - DNA, 985 bp, Homo sapiens
  CDS 21..752
  sig_peptide 21..107: Von Heijne matrix score 3.61056351168286 seq FPLYLLNFLGLWS/WI
gtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaataaaaaaaaaaaaaaaa

SEQ ID NO: 119 - DNA, 839 bp, Homo sapiens
  CDS 185..715
  sig_peptide 185..253: Von Heijne matrix score 9.49395175807817 seq SLLFICFFGESFC/IC
atattttgctgactggcaaggttatatgaagtgcttttattgaagcaccattttaactaacagctcctggtattttctgcttcccttcgtagggaatttagttattttattttattatttagctaatttagctattttaaaatagctaaattttagctacttttttttcaattgacaaagaaggatgtctaatcaaagactaccgctgattttttctctgttgtttatctgcttcttcggggagagtttctgcatttgtgatggaactgtctggacaaaggttggatgggagattcttccagaagaagtacattattggaaagttaagggttctccatctcactgcctgccttatcttctggataaactatgctgcgactttgctaacatggatatatttcagggttgtttatatctcatttataatttattacaagctgtcttcttcgtcttatttgttttgtctgtgcattacctgtggaagaaatggaagaaacaccaaaaaaagctgaaaaagcaagcctccttagaaaaacctggtaatgatctagaaagcccattgatcaacaacattgaccaaacactccacagagtggcaaccacagcatcagtgatatacaagatctgggagcacaggtctcaccatccttcctctaagaaaattaagcactgcaaattaaagaagaagagtaaagaagaaggagccagaagatactaaataaatgcatatgcaaatgtagcttactcaattatagatatcacaaaagaaatctatcatctaaggattaaaaattgttctttggaaacctttataaaaaaaaaagaaaaaaaaaaaaaaa

SEQ ID NO: 120 - DNA, 583 bp, Homo sapiens
  CDS 54..527
  sig_peptide 54..116: Von Heijne matrix score 6.80928714315144 seq ALXSLNLAPPTVA/AP
aacgtcatctaggagcaccgagcagcttggctaaaagtaagggtgtcgtgctgatggccctgtgcgcactgacccgcgctctgccstctctgaacctggcgcccccgaccgtcgccgcccctgccccgagtctgttccccgccgcccagatgatgaacaatggcctcctccaacagccctctgccttgatgttgctcccctgccgcccagttcttacttctgtggcccttaatgccaactttgtgtcctggaagagtcgtaccaagtacaccattacaccagtgaagatgaggaagtctgggggccgagaccacacaggtgctggaaacgtgcgtagaacagtaggccgagtatccaacgttgatcataacaaacgggtcattggcaaggcaggtcgcaaccgctggctgggcaagaggcctaacagtgggcggtggcaccgcaaggggggctgggctggccgaaagattcggccactaccccccatgaagagttacgtgaagctgccttctgcttctgcccaaagctgatatccctgtactctaataaaatgccccccccccctcaaaaaaaaaaaaaaaaa

SEQ ID NO: 121 - DNA, 1024 bp, Homo sapiens
  CDS 129..686
  sig_peptide 129..185: Von Heijne matrix score 6.45239823575329 seq SVFLLMVNGQVES/AQ
cttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagctatcacagctccccggaaagctgtcttctctgtccatggcctcacctcacccagggcactggccttggtccacatcaaggggacctgaagcttccctgaagcctctagcctgtggtgtgcacgtacaagcctcaggccccatttgtccagcctgtcagcagctgggaaatactaagtcaccctcttctggttatgtttaattttccaatttttctcaacattactgaaatgtctaaatgtggaaaagttgacatcattttacagtgaacaccacatacccaccacctagattttaccattaccaatttcctgttccgtacttgtatattcacatatatccaactattcatccctgcttcaatccatcctatttttattgcatttcaaaataaactgtgaaatcaggaaaaaaaaaaaaaaaaa

SEQ ID NO: 122 - DNA, 760 bp, Homo sapiens
  CDS 165..614
  sig_peptide 165..305: Von Heijne matrix score 5.10820788278539 seq ALGLALCSTKALS/VG
aatttccgatgccaggcaccctcaaggcacagaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaaggtagcaagtcaagagccttcgtgtcaccatggccacacaccccgatggcttccggcttgagggacccctggctgcagcccacagccctgggccttgcactgtgctctacgaaggccctgtccgtgggctctgcccctttgcccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccctcaaaaaaaaaaaaaaaaa

SEQ ID NO: 123 - DNA, 594 bp, Homo sapiens
  CDS 192..476
  sig_peptide 192..326: Von Heijne matrix score 6.60884760057354 seq FILLLLLSGPAEM/SA
acttttattgaaaaagactacagcaaatcatactgaggtgaatgaagacagtgaaatgaaggagaaggcaggtcctctttatgttttcgcagctggttcaaggggtttggggttttctatctaggttaaagattgcgtaatacacagctggagccatagacattaatgcatgtttatcacacgcaacaacgatgctgcatcatgtgattacagctgggcctgtgctgcttctacacctccctcgccctgacacttccaccaggttgctcctcacctccgtctctgcttttatcctcttactgctcctttcaggaccagcagaaatgtcagcttcccaggaatccttccctggatctctgcagcaagaaatagcttctctgatcactgtagcacttggttctttaatatctttatcttgctctaccttgttatatttttcttgtgaacttaaaattccctgtgaggacgtaaacctttgaaggtatgtctcatatctctgaacctctttaaaatgcctagcatccctgtgtgggtgccaattgcttgtgtattgaattaaattgtgattgttaacttgaaaaaaaaaaaaaaaaa

SEQ ID NO: 124 - DNA, 559 bp, Homo sapiens
  CDS 16..297
  sig_peptide 16..93: Von Heijne matrix score 6.65836819891491 seq FCGSACLLAVIRA/FF
ttacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaacaaaaaaaaaaaaaaaaa

SEQ ID NO: 125 - DNA, 744 bp, Homo sapiens
  CDS 216..635
  sig_peptide 216..335: Von Heijne matrix score 4.38054120608596 seq ITLVSAAPGKVIC/EM
gcttcgtcacaagggtgcgatgaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaaaaaaaaaaaaaa

SEQ ID NO: 126 - DNA, 824 bp, Homo sapiens
  CDS 164..280
  sig_peptide 164..268: Von Heijne matrix score 5.73290676305402 seq TLPLCPVTSPVWG/WS
tgtgttcaatcgtgtgaatggccggcgggccccctccacgtccccatccttcgaggggacccaggagacctacacagtggcccacgaggagaatgtccgctttgtgtccgaaggtagcgagcggggccagagggtgcggcataggctgctgggtcgcaaaaccatggacccgggatggccccacttcaagctgacccacagccgctgcatggctgtgcttttccttggcactctgcccttgtgtcctgtgaccagccctgtgtggggctggagtccagggtgaccatcaggccctgggtgggcgatggggtgcctgggacctggctcagcccgactgccctcctcccacagcctggcagcaggtgcaacagcagctggatggtggcccagccggtgagggcgggccaaggcctgtgcagtacgtggagaggacccccaatccccggctgcagaactttgtgcccatttacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaaaaaaaaaaaaa

SEQ ID NO: 127 - DNA, 526 bp, Homo sapiens
  CDS 68..301
  sig_peptide 68..190: Von Heijne matrix score 4.68908216483476 seq AYLLYILLTGALQ/FG
acatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcaaaaaaaaaaaaaaaaa

SEQ ID NO: 128 - DNA, 618 bp, Homo sapiens
  CDS 179..427
  sig_peptide 179..298: Von Heijne matrix score 7.72883276007822 seq CLVVVTMATLSLA/RP
aagcgaagagatgggtctgcactttggaggagccggacactgttgactttcctgatgtgaaatctacccaggaacaaaacaccagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacataaaaaaaaaaaaaaaaa

SEQ ID NO: 129 - DNA, 776 bp, Homo sapiens
  CDS 22..297
  sig_peptide 22..66: Von Heijne matrix score 4.68058603039206 seq VLAGSLLGPTSRS/AA
actgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaatatcaaacgcaagaacaagcacggctgggtccggcgcctgagcacgccggccggcgtgcaggtcatccttcgccgaatgctcaagggccgcaagtcgctgagccattgaggatcgcgacgcagtcggcggggaccctcatggaagcatcgccctcgcctcggaccttgcctggcgctatttttgcagggagctggggagcaggaacgcctcggacctgagtgctctccatattgtgggtttgaagtctggatgggagccttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagataattacaaagcttatcacatccaaaagaattatcaataattttgaaatattattaaacgtgtaataaatgttcaaagttcaaaaaaaaaaaaaaaaa

SEQ ID NO: 130 - DNA, 998 bp, Homo sapiens
  CDS 9..845
  sig_peptide 9..134: Von Heijne matrix score 6.13963522287438 seq RSLALAAAPSSNG/SP
aacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaacctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcattaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattaccaaaaaaaaaaaaaaaa

SEQ ID NO: 131 - DNA, 779 bp, Homo sapiens
  CDS 27..578
  sig_peptide 27..119: Von Heijne matrix score 4.50637135496675 seq TALMVGAASLLEG/RP
atctttctggactggccctgcagaggatggcatgcaccactactgcccccgcccaggaacacatgcttctcacccctctcactgctctgatggtgggggctgcttctctgcttgagggccggccacagatctcagctccatactcccgagctgcatgttgcagccctggggcactgggatgtcctgcagctcgggttgggattctggatctgatgtattcctgggttgccaggaaagtgctcaggtgcagcaatactgggctgcaggggctgcactgtgcaccagcttatgcagcacagcttggtatggaccctgggaggggccaacgagcaggagggcctgtagagcagacatacttcagtcccatggggaagctgcccactctttcgtggctggaaggctgtacagcagtcatgacgctggcatctgcttggcttctggggagccctcgggaaacttacaatcatgagaaggtgaaggagaagcagtgtccattctccagtatggttttgggggagtatggcttcctacctactgtggaccacctgtcaactctgggctgtaacatgagagaattgtgaacttctgtcttgtttgagccatggtttcattctctttttcagccatgtagcctgtgctgtaactcagtaccacattagcaactagtgaaagtcaatgtgggtaaatttgtcattcttcaggttagaacatttcttccttttattcttgtgtttttggctaaataaactgggaaattatagtaaaaaaaaaaaaaaaaa

SEQ ID NO: 132 - DNA, 1025 bp, Homo sapiens
  CDS 408..710
  sig_peptide 408..533: Von Heijne matrix score 5.66440183652506 seq QLCFHLSWLYSWA/SQ
atggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctcattactcctggtcttgggagttgccttctgaggatactccactgggggtacctgagcctggattagagggcagggggaggatattgcctagccaaagtgggtgttcaataaagaaccatttggagatggcaaaaaaaaaaaaaaaaa

SEQ ID NO: 133 - DNA, 607 bp, Homo sapiens
  CDS 247..501
  sig_peptide 247..306: Von Heijne matrix score 6.43040298500966 seq LLLVTLVASTVPG/NS
tgttacaaatattccctatgatctctcctttaaatattcttatcaggatattggaaattcttgattttcacaactctgcttcagtggcatatgtttagctttttgtcttctgaattaattgggcttctgatggtccctagaggtatcagctactcagtcagaaaacatacatggggaagaaactgaagttcatgccacaaactgtagcagctttggaacagaagggaccagacaacctcaaggagaatgggcccaaataccaaaaatttactcttggtgacccttgttgcttctactgtaccaggcaactctcttgggcaggattttacttttgcacacttagaaagatcctgcaccagggaaaatcggtctcctggggaggtattccagcaaccatgcaagtctggaggcgggggggttggagaaccaaatgcccaagggcagctacttagccagcacccactacctgccttcattaattgttctcacgggcaggccttttgaaccaccctggtacagaacaccaaccctggtgctttaggctgtctgtgccatttctaggcaatgaacgagtagttactgtaccaacccaaaaaaaaaaaaaaaa

SEQ ID NO: 134 - DNA, 774 bp, Homo sapiens
  CDS 333..602
  sig_peptide 333..416: Von Heijne matrix score 4.79986448293481 seq VPALPLLSSLCMA/MV
ctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtttttccagcgctcttgggaggtgggctgtgccctgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgktcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacaaaaaaaaaaaaaa

SEQ ID NO: 135 - DNA, 611 bp, Homo sapiens
  CDS 110..376
  sig_peptide 110..208: Von Heijne matrix score 3.64796206065748 seq LVPHSPLPGALSS/AP
  misc_feature 347: n=a, g, c or t
tcttgtcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcatcacagcgggctactcctagggataagcccnccggtcccctcatccctggccagtgtccctgacccccatctactccttcctggggacttctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcaaaaaaaaaaa

SEQ ID NO: 136 - DNA, 925 bp, Homo sapiens
  CDS 22..417
  sig_peptide 22..66: Von Heijne matrix score 5.47092708754574 seq RVLCAPAAGAVRA/LR
agtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataataaaaaaaaaaaaaaaaa

SEQ ID NO: 137 - DNA, 674 bp, Homo sapiens
  CDS 62..367
  sig_peptide 62..103: Von Heijne matrix score 4.49063834776683 seq FLTALLWRGRIPG/RQ
acgccacggcgtctgctggcggccgcggagacgcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgatgcggagaaccattactggctgagcatgccctacatgacccgggagcaggagcgcggccacgccgsgdtgcgcaggagggaggccttcgaggccataaaggcggccgccacttccaagttccccccgcatagattcattgcggaccagctcgaccatctcaatgtcaccaagaaatggtcctaatcctgagtagtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaaccccccaatacttaaaagtctaattgctgtcctgtggtttcattagtctgataggaagatagggatttcctcagtcacagatgatattttgaaggaaagctgcaataaagccacaatgattcgaaaaaaaaaaaaaaaaa

SEQ ID NO: 138 - DNA, 1725 bp, Homo sapiens
  CDS 107..1618
  sig_peptide 107..178: Von Heijne matrix score 6.19650168602189 seq LGLYSLVLSGALA/YA
agagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacagcttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacattgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacaaaaaaaaaaaaaaaaa

SEQ ID NO: 139 - DNA, 1474 bp, Homo sapiens
  CDS 16..471
  sig_peptide 16..93: Von Heijne matrix score 5.809301698725 seq FCVCVIAIGVVQA/LI
tacacgttttcgttaatggtgaccttccctgatgtgcctctgggcatcttcttgttctgtgtgtgtgtgatcgccatcggggtcgtgcaggcactgattgtagggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctggtgaggaccccgcgtcacctgccccagctatcaggtggccaatgtgtcttgagtccctggcgtctcatcctggaaaccccagaaaggcacaggggtcttggctccaccctcctctggatgcctagagttttgtgtgaggtcagggcagcccccacttcagggaggacaaccttcccggcggcccctcccttcccagcggcccctcccttcccagaggctcccaccccaagcacagccgaggatggggtgccagggtgaggtcagcaccagcagccaactgctctcctcactcctctcagaggggctcagcagccatgggtatccccctgccccaggcctcacccctgccccaacaccagcccctcctagtccctagtccctcccattccctccggctccctcccagtgccccccatcgcttcgcagccccttctgctccctttggctggctgttgcttccttccagcgtctgctcctccgcggcctcatctgcctcttcgtctgttagagcgcgcgtctcgtctcagtcgtcacgtttttggtttttgtggggtttttttttttttttttttttgagacagtcctgctgtgtcgcccaggctggagtatagtggctcaagctcagctcactgcaacctccgcctcccaggttcaagcaattctcctgcctcagcctcccaagtagttgggattacaagcacccaccaccatgcccagctaactttttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctccaaaaaaaaaaaaaaaaa

SEQ ID NO: 140 - DNA, 653 bp, Homo sapiens
  CDS 222..374
  sig_peptide 222..299: Von Heijne matrix score 4.28353322771141 seq ILFKFSLCPYAAA/LS
taataatgttgttaaattattgccttctcatctgcgtgtctcttatgttctgcttaaagagattgtcagtttgttcaagctctttttagttgttgctcctccagtgcctagctttgagctttgtacacggtagttattgagttgagtaacatagtttgttctgagtcatttgttccacatgcttgaagacttggcttaacctagtagataataggaaagaaatggaaatgctctttgatgaaagagcccctctcttattcatcctttttaaattttctttgtgcccatatgcagcagctctcagcaaacctatatttggcagtgtggcctgtatgactaaagaaatcctggccaggcacggtggctcacgcctgtaatcccagcactttgggaggccgaggcgggtggattacgaggtcaggagattgagaccatcctggctaacatggcgaaaccccatctctacgaaaaatacaaaaaaaaaaattagccgggcatcatggcgggcgcctgtagtcttagctactcaggaggctgaggcaggagaatggcgtgaacccgggaggcggagcttgcagtgagccgagattgcgccactgcactccagcctggggcaacagagcaagactccgtctcaaaaaaaaaaaaaaaaa

SEQ ID NO: 141 - DNA, 1490 bp, Homo sapiens
  CDS 59..274
  sig_peptide 59..127: Von Heijne matrix score 7.37647149292058 seq LGLCSLLVGEAEA/PS
agacagaggcagggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagatttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcttaaaaaaaaaaaaaaaaa

SEQ ID NO: 142 - DNA, 661 bp, Homo sapiens
  CDS 158..442
  sig_peptide 158..301: Von Heijne matrix score 7.53908709538105 seq FVILLLFIFTVVS/LV
aaaaacagacgataccatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaaagcagctcaacctcttctgagaaaaaaaatatattctgaggccaactgttgctacaaaacaaattctgactgaatgtttaaaacatttctagtagaaggggaaaaaaaagttaaacatgcactgtttgtgtgtatagccatttcattaaatatacagtaaaacttcataaaaaaaaaaaaaaaaa

SEQ ID NO: 143 - DNA, 1789 bp, Homo sapiens
  CDS 5..454
  sig_peptide 5..64: Von Heijne matrix score 6.64507667657896 seq LLPLLSLLVGAWL/KL
cctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattcttttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaaaaaaaaaaaaaaaa

SEQ ID NO: 144 - DNA, 2006 bp, Homo sapiens
  CDS 241..1302
tagtgccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgtgtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgacccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgcagacccaggagagttgagagggtgggggacacacacagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaaccgaaaaaaaaaaaaaaaaa

SEQ ID NO: 145 - DNA, 1096 bp, Homo sapiens
  CDS 15..635
atccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaacactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggcaaaaaaaaaaaaaaaaa

SEQ ID NO: 146 - DNA, 1666 bp, Homo sapiens
  CDS 109..738
cccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctacttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaaaaaaaaaaaaaaaaa

SEQ ID NO: 147 - DNA, 1687 bp, Homo sapiens
  CDS 21..1145
gtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtatttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattcccagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagraatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaggaaaaaaaaaaaaaaatgcgaaa

SEQ ID NO: 148 - DNA, 1747 bp, Homo sapiens
  CDS 70..1596
gttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacaacagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaaaaaa

SEQ ID NO: 149 - DNA, 658 bp, Homo sapiens
  CDS 129..362
agtcaggaaaatgaagctgaacatcaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggagcttcaagagagggatttgttcatcttgttgacttctgtatcaggacatctgcccgatacatagaaaaagtctgctgacccctgaattacagtatgagccattcggaatgcatttctctttaaaagttctcgcctcattcagtgtctggaacacagtgggtgctccccaataggtgacaccttcctcaagtttccttgggagaacagactcaatgtcggatccacaaaggagacctgcacatacctaacccctatttctgcagaagctgaaggctgtattatctattgcttgcataataaatattgcataacgacaacaatagtaaaaaaaaaaaaaaaaagaaaaaaaaaaaaaaa

SEQ ID NO: 150 - DNA, 2045 bp, Homo sapiens
  CDS 109..594
attattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggatagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataacccaatagtgaatgttgcccaaaaacgtgagcttggataagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaatccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttggaaaaaaaaaaaaaaaaa

SEQ ID NO: 151 - DNA, 788 bp, Homo sapiens
  CDS 150..587
attttcaaatttacccctctgtgacttgtaagccatgcaattcgtagggctaaatatgcagttgttcgatttcacggtttggaatctcttgtcaagggactgggactcttcaattaatctgacatttcacaaatccaaaattgccgtggatgaactctttacttcacttcgggatattgctggagctgagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtacstttgcttggattgctgtgattccaaaaaaaaaaaaaaaaa

SEQ ID NO: 152 - DNA, 1931 bp, Homo sapiens
  CDS 173..847
actggatactatctggccagaagtagcaaagcagctcttatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcgcgggcatggtggtgctcatccctgtgagctgggttgccaatgccatcatcagagatttctataacccaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttctcatcgcacaacccaaaaaagttatcacaccggaaagaagtcaccgagcgtctactccagaagtcagtatgtgtagttgtgtatgtttttttaactttactataaagctatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaatccaatgctttgattgttctagaaagtatagtaatttgttttctaaggtggttcaagcatctactctttttatcatttacttcaaaatgacattgctaaagactgcattattttactactgtaatttctccatgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccaaaaaaaaaaaaaaaaa

SEQ ID NO: 153 - DNA, 514 bp, Homo sapiens
  CDS 100..441
ataccaggcactttagaaccagagactctgctgcttttcctgggcagggcctgcttgctccagctctcaagtctgacttgcatctacactgcgggcaagatgcggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaatgctcaacggagccatgttcttcaaccgcctgtccttggagtttctggccatcgagtaccgggaggagcaccactgaggcctggggagtcggaacagggctaaggagggggaagcaaaaggctgcctcgggtgttttaataaagttgttgtttattccaaaaaaaaaaaaaaa

SEQ ID NO: 154 - DNA, 1183 bp, Homo sapiens
  CDS 32..1132
acttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggtcaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcaaaaaaaaaaaaaaaaa

SEQ ID NO: 155 - DNA, 1545 bp, Homo sapiens
  CDS 160..996
acacagcatgcatttcttcaacaagcgactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccgctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacttgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcaaaaaaaaaaaaaaaaa

SEQ ID NO: 156 - DNA, 1068 bp, Homo sapiens
  CDS 11..529
gaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgggatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctaaaaaaaaaaaaaaaa

SEQ ID NO: 157 - DNA, 1097 bp, Homo sapiens
  CDS 135..749
aacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggcmgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccgtctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtggaccaaaaaaaaaaaaaaaaa

SEQ ID NO: 158 - DNA, 894 bp, Homo sapiens
  CDS 98..637
ctttggggccgaagtgggcgtgcggctcgcgctgttcgcggccttcctggtgacggagctgctccccccgttccagagactcatccagccggaggagatgtggctctaccggaacccctacgtggaggcggagtatttccccaccaagccgatgtttgttattgcatttctctctccactgtctctgatcttcctggccaaatttctcaagaaggcagacacaagagacagcagacaagcctgcctggctgccagccttgccctggctctgaatggcgtctttaccaacacaataaaactgatcgtagggaggccacgcccagatttcttctaccgctgcttccctgatgggctagcccattctgacttgatgtgtacaggggataaggacgtggtgaatgagggccgaaagagcttccccagtggacattcttcctttgcatttgctggtctggcctttgcgtccttctacctggcagggaagttacactgcttcacaccacaaggccgtgggaaatcttggaggttctgtgcctttctgtcacctctactttttgcagctgtgattgcactgtcccgcacatgtgactacaagcatcactggcaagatctgctcaaatgcaccaacactgccaagtgactaaggtagaaaagaaaaatgacaggtatcgtcatctgaaggacagatgaatctttttctgccccttcttcacaatggaatataaggaacaattatgggatgtcatcagaatggatgccataggacctacagctccctttctctttattgtgattatactttaaatatgacattgtcttttatgtgtatgttcctatattttcaatgtatctttttccttcagtaaacctgatattcaaaaaaaaaaaaaaaaa

SEQ ID NO: 159 - DNA, 703 bp, Homo sapiens
  CDS 221..670
aaggaagcgccgccccttcctacggctacgggaaggatcgtccagtggctgaggctggacagagcacagacaaaagataaaaagcaagatttgagagaggttcctggatcaactggctcaatctgcttagttctacaaagtggagtttctgggcatcattcttcatttctgtacacaaagtgctgtgaagctcaagaagaaatagctctgcacaggaacgatgtgcactgccctactgcttctttatctaagatggtgtttcaacttaaaacttgtgaatgtgaaatatgagccaaaagactctctcggccctgaaatgacctttgtagcagatgctgccagaggccccctgttatcctccctggactctccagctaacctgatgtcaactgccagtgtgtgcatctccttacctgagggctgttctggtggcaggagtccttgctactcacagaaatggccaccagaagtgccagaaaaattaacctcccttggccagcagtcctcaaccagctccctcactgacactgatgtgcaggtgtctcctatgctggttgctggagtcaaccacagcagcagccttcttgacaacatacccttcactggctgccttcctttccatctctcttcttcactcccctacctatgtctcctaggctctcccttcaaataaacagcttgcacttgaaaaaaaaaaaaaaaa

SEQ ID NO: 160 - DNA, 849 bp, Homo sapiens
  CDS 165..674
aaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattctcaaaaaaaaaaaaaaaaa

SEQ ID NO: 161 - DNA, 846 bp, Homo sapiens
  CDS 165..671
aaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagcacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattctcaaaaaaaaaaaaaaaaa

SEQ ID NO: 162 - DNA, 1176 bp, Homo sapiens
  CDS 28..1128
ctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatctcgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgacaaaaaamaaaaaaaaaaa

SEQ ID NO: 163 - DNA, 1084 bp, Homo sapiens
  CDS 135..194
aacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggcaaaaaaaaaaaaaaaaa

SEQ ID NO: 164 - DNA, 1793 bp, Homo sapiens
  CDS 173..847
gsmggrggccattacctagaacatcstaatcgaarrattatttgaaaaaccactgggttccgagttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtattgtaatttgttttctaaggtggttcaagcatctactctttttatcatttacttcaaaatgacattgctaaagactgcattattctactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttatggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatgtatatattttaataagtatttgagtacagactttgaggtttcatcaatataaataaaagagcagaaaagtaaaaaaaaaaaaaaaaaa

SEQ ID NO: 165 - DNA, 1849 bp, Homo sapiens
  CDS 8..1141
  misc_feature 1707: n=a, g, c or t
cgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcggacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttagctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtaggggggccaataaacatgaaaaaatcccagccctagtagcaattaaggaaatagcaaaacaggatttctgctcctcttgagggggtctcatgggaacacaggtgcactttcccacacttgtccccccaggtgactaggttcaagagacatttgcttttggtggccccacaaacatttccttttgagggcccatagtgaatatntaaagtgtgctggacatggtggctcatgcctgtaatcccagcactttcagaggctgaggtgggcagattgcttgagctgaggagtttgagaccagcctgggcaacatagcaagatcccttccccaaaaaaaaaaaaaaaaaa

SEQ ID NO: 166 - DNA, 1748 bp, Homo sapiens
  CDS 136..264
attatttgaaaaaccactgggttccgagttcattactacaggaaaaactttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggttttttaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaaccgaatgctttgattgttctagaaagtatagtaatttgttttctaaggtggktcaagcatctactctttttatcatttacttcaaaatgacattgctaaagactgcattattttactactgtaatttctccacgacatagcattatctacatagatgagtgtaacatttatatctcacatagagacatgcttatatggttkcatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcaaaaaaaaaaaaaaaaaa

SEQ ID NO: 167 - DNA, 1275 bp, Homo sapiens
  CDS 14..1048
agaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccacttttttcagctgtgtcccccagtccgtgtctttttagaatgtgaatgatgataaagttgtgaaataaaggtttctatctagtttgcaaaaaaaaaaaaaaaaaa

SEQ ID NO: 168 - DNA, 1023 bp, Homo sapiens
  CDS 70..777
aataggtccggttccgggggcgcgtggctgcagcggggcccgcgtggtgcctcctgaggcggcccccggatgaagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcctacagcctggtcctcgcactcctgggactgggcgtcgtgctcgtgctctccagcttctttgcactggggttcgctggaactttcctaggtgattacttcgggatcctcaaggaggcgagagtgaccgtgttccccttcaacatcctggacaaccccatgtactggggaagcacagccaactacctgggctgggccatcatgcacgccagccccacgggcctgctcctgacggtgctggtggccctcacctacatagtggctctcctatacgaagagcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgacctcaaaaaaaaaaaaaaaaa

SEQ ID NO: 169 - DNA, 1085 bp, Homo sapiens
  CDS 38..400
aacaattcatgaagttgaagaaaagacactgtcagaaatgaacacagaagcggagcaacagcttctccatcacgccagaaatggcaatgctgaagaagtaagacaactattagagaccatggcgagtaatgaagtgattgctgacattaattgcaaaggaagaagtaagtctaacttgggctggacacccctacatctggcatgctattttggacacagacaagtggtccaggatctgttgaaggctggtgcagaagtgaatgtgttgaatgacatgggagacacgccgcttcatcgagctgcctttacaggacgaaaggtgaaaatcattctatgttcaatgtttgtaagtgaggtatttggaggagtagttaccattgttttctctgttataaccatctgaccagcaaccgaagaaagccacacaaaaaaatgtatacaccagcactttgggtcaaaaggccacaggatcttttgagtctgacagtgaggtccagtactaaggtcatggagacccccactctgtagcatccctgtgaggagatcattccgtttctgcttgtgtactccagcaatggggaactcctgattattctttttttttaaaaaaaaatagcttcattgaggtataacttacattgcataaacttcacctgtgatattgtgaaatatatatttggtctttgaccttgtacactaaagatgtacaaaaagatgactggcaacccctggcttcaggatgggggctggtcaccagaaagaccaaggcaggactagggggttgggactttcagccgaactttgcaacctccagggagggtagaggggctgaaggggaaatggctcgctaatggccagtggtttcatcaatcatgcctatttaatggaacctccataaaaacctgaaaggacagggttctaggagctcctgggtagctgaacacgtggaggttcttgaatgatcacacccagggagggcatgggtgctctgtgcccttcctccatgccttgctttatgtatctcttcatctgtatcctttgtaataaagcagtaaacatgttttcctgaaaaaaaaaaaaaaaaa

SEQ ID NO: 170 - DNA, 776 bp, Homo sapiens
  CDS 63..572
atatgtcatcaggccccccgcctgggaggtgtgctgccagagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagcaaaaaaaaaa

SEQ ID NO: 171 - DNA, 1219 bp, Homo sapiens
  CDS 160..867
gtagttaggagtctggagtcgtgagccggagtcagaactgcgtctcgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggccgtggcctctagctccctctttgacctctcagtgctcaagctccaccacagcctgcagcagagtgagccggacctgcggcacctggtgctggtcgtgaacactctgcggcgcatccaggcgtccatggcacccgcggctgccctgccacctgtgcctagcccacctgcagcccccagtgtggctgacaacttactggcaagctcggacgctgccctttcagcctccatggccagcctcctggaggacctcagccacattgagggcctgagtcaggctccccaacccttggcagacgaggggccaccaggccgtagcatcgggggagcagcgcccagcctgggtgccttggacctgctgggcccagccactggctgtctactggacgatgggcttgagggcctgtttgaggatattgacacctctatgtatgacaatgaactttgggcaccagcctctgagggcctcaaaccaggccctgaggatgggccgggcaaggaggaagctccggagctggacgaggccgaattggactacctcatggatgtgctggtgggcacacaggcactggagcgaccgccggggccagggcgctgagccctcgtgctggaatggttgtctggtatctgaactgagcctgctggctggaccaactgtcctcgaaaagacacagctggcttccctagtacagagaacagggcttgggccactttggagagacagaatctagtcctgggcaacttcacatccgtcctcctgtctcagggctggcagggggagcctggaattaccccctagtgatggaatgacagggtctggtggggacttaattccctggccctggggtcatagcttgggctgttccttctctgatacgggaagagaccccaatcagatttttcaaattaaagccagtcctgggaaatctcaaaaaaaaaaaaaaaaa

SEQ ID NO: 172 - DNA, 1487 bp, Homo sapiens
  CDS 68..640
gacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagcaaaaaaaaaaaaaaaaa

SEQ ID NO: 173 - DNA, 1915 bp, Homo sapiens
  CDS 132..1298
aactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatctaacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaagaaaaaaaaaaaaaaaaa

SEQ ID NO: 174 - DNA, 1990 bp, Homo sapiens
  CDS 259..1701
ttagaacatcytaatcaaaaaattttggtgcgagagaaacaataggacggaaacgccgaggaacccggctgaggcggcagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctcagatgtcactggtatctaggcaacagggatgagcctgaacctccctgaggccagcttacttagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgcaaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacaaatttatcttactggaaaacctgacttcccgctatgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggmacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattataaaaaaaaaaaaaaaaa

SEQ ID NO: 175 - DNA, 1971 bp, Homo sapiens
  CDS 213..1274
ttcagccccagccagatcccgcgtcaacggacgcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgccaaaaaaaaaaaaaaaaa

SEQ ID NO: 176 - DNA, 1613 bp, Homo sapiens
  CDS 68..127
gacgaaggactggaaggtggcggtggtgaaggtgcaggccgttggggcggctcagaggcaggtgactatgaaaggcttatatttccaacagagttccacagatgaagaaataacatttgtatttcaataaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaamaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcactcaaaaaaaaaaaaaaaaa

SEQ ID NO: 177 - DNA, 1361 bp, Homo sapiens
  CDS 65..1024
gaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttatcttaaaggatgtgatggagaagttatcaactggtgttttcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattctggcttctaatcctgcctctgttcccttttctctccttgaaagtccagcacaccattcttgtccttccccagtttcctcgccctccacccctccagcttcatgctcagtgttgtgcttaataaaatggacatatttttctctaaaaaaaaaaaaaaaakaaaaaaaaaaaataaaaaaaaaaaaaaaaa

SEQ ID NO: 178 - DNA, 1113 bp, Homo sapiens
  CDS 109..585
gcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacattgtggaaaagagcacttgaatgtatggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctcgtgctgcaagataattaaacttttttgcttttaaaaaatgtctgcatttttaagattttttttactttaaatgtgaaacttattttaagctagaaamattgcttattatatgtaataaaaataatatataaatctttacaatktttgaaataaacccatccttggaaaaataaaaaaaaaaaaaaagaaaaaaaaaaaaaaaa

SEQ ID NO: 179 - DNA, 1960 bp, Homo sapiens
  CDS 29..577
atcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtattcaaaaaaaaaaaaaaaaa

SEQ ID NO: 180 - DNA, 1443 bp, Homo sapiens
  CDS 23..451
accggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactctgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgatactgcaggagagagagcagcggagggccacattcggagcctccgtccactccagttttatcagcttttgcttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctcaaaaaaaaaaaaaaaaa

SEQ ID NO: 181 - DNA, 605 bp, Homo sapiens
  CDS 232..450
caaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctagctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctaccaaaaaaaaaaaaaaaaa

SEQ ID NO: 182 - DNA, 1724 bp, Homo sapiens
  CDS 758..1183
aactaaagccgggagtccggtgaacgggcagaagcagggccatgcccaagccacccccaagatccccctgaacctgcacctccatcacgacccattcaggagcctccaggagcccagacaccagccccccaccatggtaagtccttcaagggtgggatctggaagaggaaagaggagggacaccagccaggtggaggtgtcctaaaaatgaccatcagaaattggggtgaggggaggggcatggtggacttctgtgggggtggggtgtctctcagtgcagctcaggtgcctccagcatcccttaccagggagcaagctcccatctgtaggtggtggggatgccagggtggtatccctggatccaaggatagggcaggacctggaagacagaaggtggcccagggagaatcacagagtctgcagggacaaggacatagcctcctttgcttgcaaattaagggagccctttcccagtccagcccagtctctcgtctccctgtgtagccttgggctagtcacttcccctctcttggccccggttcccacagatgtcatatttggaaatccgtctagatgcggaagttgctcttcaggggtctttcagttgcaacattctcaaggtctgtgggttctgccacagagtcctcggctgagatgggaagctatgtctaacaagcgatggggtggattgacgccctccctgtgccggtgacgggcggtatggctgcagcagaggcaggagaggctgaatacgtccatgccaccctttggtgggcatcccttatcccaagaggaggatggcagccagaggtgttgctgcctgtcaagtctgaggtctgtcgatgatagcaacggggagactgtcgtgatcatggcgctattcctagcagtatcgtaccaccataagacgcaaagtaagaggtggccagggctgaccccaccccacagctctctgctgtgtagaccacttcagctttcatttctcgtcattcagtcagtgaggatgagagcatgtggctgtgacagcggccactgcaggattcttggcaggtacagcttactagggtggagtcagggacatagggcaagaggcagaggtggtgttagtctgagagacaacaccttctttcaggaagccagtgagggccagggacagtggctcatgcctgtaatcccagcattttaggaggctgagacaggtagatcacttgaggtcaggtgttcgagaccagcctggccaacgtggtgaaacctcgtctctactaaaaaatacaaaaaattaactgggcgtggtggcacacgcctgtaatcccagctacatatgaggctgaggcaagagaataacttgaacccaggaggcggagggtgcagtgagctgagatcctgccgctgcactccagcctgggtgacagagcacactccgtctcaaaaaaggaaagctgatgagaaattgggcatcccggaattcacacccaaaccatcagctggagctctgagactgttggggtgggaattcttccaagatgagaagcaagccagggaggctcaggtcctgggatgggcagggctttgatcaaaagaacacaggaagtgatttgctacttgaaagaaaggcaacccctccccaaggaagccctctgaaaatgcttagtcaacagtcggcttggcagacaaggtctgggaggggccacccgtatcgcagaggacaaaaaaaaaaaaaaaaa

SEQ ID NO: 183 - DNA, 1686 bp, Homo sapiens
  CDS 486..932
cggctcactgcagcctcttcctcccagtctcaagtgattctcctgtctcagcctcctgagtggctgggattacaggtgtgcaccactaccacttggctaatttttatacttttagtagagatggggtttcaccatgttggccaggctggccttgaactcctgacctcaggtgatccgcccgcctcggcctcccaaagtgctggggttacaggcatgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctgggggtgcagttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctctttgtctctgtacatgcccatttcagagtccaggctggtgggagagggaacagagtgggaaagaaaactagggtaagcagaaacgatgaaaccttataagagtgagattatcatgtgcaagagtgagattatcatgtacaagagatcccaggaaatactgactttgatgaaaaagtcacatcagagcactcagttttggcagagctttttctgccgaatgtttactcacattcactgtccgagattctatactgggggtacacacgtcctctgccctaaggcaattttgagtccaagagacattttgaggcctaaaaatcataggaaactgcccctgagctcacacatatttccaatggtgtccccaatttcagggaatccatggattacctaagccagcccctccagttcggctaagaaactctagtctatatgtcaagttttgtatcatatgtattgctctgaactcagaaatttcccttccatttatggattctatgaataaaatatcacatgtacaaaaagactaagtcaaaaaatttcagctgtgcacagtggctcatgcttgtaatcccagcactttgggtggccgaggggggaggattgcctgaggccagcagttcaagaccagtatgggcaacatggcaagagcccatctctaaaaaaacaaaaccaaaccaaattggccaggtgtggtggctggcacctgtgttccaactacttgggagactcatgtgacaggaagatcacttgagcccgggggttagaggctgcagtgagctatgatcttgccactgcactccagcctgggtgacagagcgagacaccgtcgcaaaaaaaaaaaaaaaaa

SEQ ID NO: 184 - DNA, 463 bp, Homo sapiens
  CDS 80..304
cttttaacagctgaggtctctctttaattctcttaaataccatttctccctcaaaaaagaccattagatcatttcacaaatgtatctgccaccaaacaggtcagagctttgcaactttgctttgtctcttaacctctatggcaaagggttttttagcctggtggaaaagcataacagcagggatttagaagatagagctagttctggcccatcactttcatctccatcacacccggactggggttatatagttctgattttagtggcaaccctgggggaacttgatacccaggtaggtggtcactgatcagtagttgggagaggtaggaattggtgagtacaggtaattagaggaaagtcttgtgtcctgtttccccccttttaattttatcccttgctagaattaagatactatatgcctcacttatcaattacagtctaaatccaaaagaaaaaaaaaaaa

SEQ ID NO: 185 - DNA, 773 bp, Homo sapiens
  CDS 188..691
agttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagcatgaaaaaaaaaaaaaaaaaaaaaaaaaaaaaaaaaaaaaaaaaaaaaaa

SEQ ID NO: 186 - DNA, 753 bp, Homo sapiens
  CDS 94..573
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagagacagagtttcaccatgttgcccaggctggtctcaaactccagtgatcctcccacctcagccttccgaagtgctgggattacagatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgttaaaaaaaaaaaaaaa

SEQ ID NO: 187 - DNA, 754 bp, Homo sapiens
  CDS 181..462
atcctatcaaaagttacggtgaagtcagggtgggtggcgagtccctgcaaggtcgcccctctgtgccaacacagcctgatggcttcttgtttcaggaaacatccagaattacaactggccattgagttattacatatcaattgaacaaggtagttttaaaatgaaagaaaatcttgcaacatgaataaagagatagactctttgaatctggcatacagctttcccttccttcttcctgctttcctggacacaccgtggacagacccatttccctctggattcatggtaaggtcccgagtgcttctgatacagctgctgagcagaccccgctcatctcaggagtcccgaggacactcgcttccctgcagcccgtccgccctccataagcctgggggcatctgccctgcagcactggggaggagccacctccttgtctgggaacagccaagcctccgtgacagctgaggattcttgtggattgttctttctgtaactggacagcacatccggaattccttgccatagctctgtgccttgctggggtctgaggttcacaggtcagatgctgctgtctggtccttcccaattgcggcgtgaattccttcatcctcaccagtagcttcttgctctccccaagggaggcacgtgcttagtagggagagaggcctaccaaggttgccatctgccatgggctcaattgtgtccccaacccccctgcaaattatatattgaagtccccaaaaaaaaaaaaaaa

SEQ ID NO: 188 - DNA, 998 bp, Homo sapiens
  CDS 6..290
  misc_feature 871: n=a, g, c or t
gattcatgaaggcctcgggtcctgacctctctgatggactccactgccccagtctaattagacatttaagaaccttctctgcagctgctgccttagccccaagatacccaaccagacttcccagttcactgcttctatggcacctctgccagtgcctccatctcctctatgcagtttctacctcatgcaacagccatgggaagagatcggctgcctgggcaatgaccagaacagaagacacagatgcgctaacagattccttcgatgacagtttcatcagttctgcagattaaagactttcaccagaaaaaaaaattacctgattttgccctgaggcagccagggagggctttgtccttgacaatcccactgacttatttaacaggtagctcaaaacccaacaaaaactggaggaggctgctccactgcagggatggtttcaattcggtaactggagtattgtactctccttgcaccctggctcatccccacaaaagacctttcaaagaaaacacttaattacctccttgcacaagccctgtaagccctaaggtgaaaagaaactcagcagacaaggtccacagagaaggagaaggcacaattcagtagggacctacgctcagcaccaggataaagaaactgtccattcctgccacctcctaggaagctaaaagaattaaggggaggccgggcacggtggctcacgcctgtaatcccagcactttgggaggccgaggcgggtggatcatgaggtcaggagatcgagaccatcctggctaacatggtgaaaccccatctctactaaaaatacaaaaaattagccgggcgtggtggcgggcgccctgtagtcccagctactcgggaggctganggcaggagaatggtgtgaacctgggaggcggagcttgcagtgagccgagattgcgccctgctccactccagcctgagcgacagagcgagactccgtctcaaaaaaaaaaargaaaaaaaaaaaaaaa

SEQ ID NO: 189 - DNA, 605 bp, Homo sapiens
  CDS 115..411
aagaaaggggtgaggcctaagggacaatcaggatgtttttcagagagaagtgtggatgctggacaggaagaaccacagataccagatacgggtactgttgtaactctgttctccatgaaaaaaaaggaagaaacaacactttcagagatggagcctgttgagccacagtaccaactagtcaatgctgaatcgacttctccctttctacattgcctgagagaagtcattggggaatactctgtacacgaattttcactgttggggaaaacagagagtcaagggattggattgtggattgcattggtggttttcctcagtttcctcatcttctccacaagtttctacatatcgaatgcagagcagcccttcttcaaagaacctcctacggaagctgctaaggaactcagtctgtagctctgcgtggagccatgtgtaaacactgaactgagacctgccacctcctactacctaagggcccattttcatctgatatcatcccccagaaacaaactcatgatgacttccatgttttttttagattagatacatggagaattttcctttcccttagaattaaaatcctgcattctaaaaaaaaaaaaaaa

SEQ ID NO: 190 - DNA, 526 bp, Homo sapiens
  CDS 3..368
agatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgaaaaaaaaataaaaaaaaaaaaaaaa

SEQ ID NO: 191 - DNA, 910 bp, Homo sapiens
  CDS 174..527
attttcctgttaggccaagagagaagaggatccttcctcagagcctccagcctcccttgatcccttgcttgtgggcatatgtgggtcatatttccctcccatcaccctctgcacgccacccccatcaccgccacagacccccagcccttcagttgccctgcacctccttggtgatgcagccgtccttgttaaggtcatacaggttgaaggcccaattaagcctgtcatctacagttccccgaagaatcacggacaaaccagccacaaagtcctgggaaggaggcaggagggagctgtgtcctcgggtactcttcacccaactccttctctgggtttggcctggagatcctggccctgaactccaggaaacaggcttccctggcccacctcgcccagctcacctcaaaactgaccgagccatcatggttggtgtcaaaggcattgaagagaaaagtggcataggtgctggagtctgcagggtgagtgtggagaagttggcttccacacaggagaggacttcctccctctaaggagctccccataccccccatcaccttggcattcccagctcctccagaatccctccctccctcagcctagagaaggacaactgcttccccttgggccttgtcccctcacctccttgaggaaagaactgggagtaaatctgcttgaagttctcctcattgacaattccgctgggacattcctggaaggagagggcaccaggctgagggcagagacaaaatccccttccgttcaccgcccccaccctccatggcccaagactcccagggagggggataatcttcaagcctccagaggactcaccacgtggctcatgtgatgggagggaagacttctttcccagtgcacaaataaaaaacatggaacgaaaaaaaaaaaaaaa

SEQ ID NO: 192 - DNA, 668 bp, Homo sapiens
  CDS 57..203
tcctgtcgacgtgttcttccggtggcggagcggcggattagccttcgcggggcaaaatggagctcgaggccatgagcagatataccagcccagtgaacccacctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaagattgccgtgggctgggctctctgcactccacagtccaccccttcgctttgccttaactgctgtgcccagttacgaggtcacctctaccaagtacactcgtgatatctataaagagctcctcatctcattagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaaaaaaaaaaaaaaaaaaaaaaaaaaaataaaaaaaaaaaaaaa

SEQ ID NO: 193 - DNA, 637 bp, Homo sapiens
  CDS 68..334
agttatgaagttctaaaagcaagtcttaatcaggaagtgtccttgatcaccaacggctcgcccaggcatgctggctctcttccacttccaccttccaccatgggatgacgcagtaagaaggccatcagtagatgccagtccctcaaccttgaactttccagacgcagaactttatgcctccattttcctctgctgcatggccccaggagagattttaattagctttctaaccttggtccagattgcacatgcaaatggtagaggatgcaacacccccgcttgtggagctgccgcttgtgtctggcatgaaaattcacaagaagagaggaaatactgaggagaaaatggcagattgtgtttgctgaatttgattgacgaagaagtcaccatgaaaatcacagtgaaccatttggaaagcaaactgccaaaaaaataatagttagtcatgctctcaggctggttgttttggctgttgtgggtttcttgcatttccagatgattgcaaagagctgtttctcaatttctgcaacaagtgccagctgaaattttggtaccagtttcattaaatatgtataacaaaakaaaaaaaaaaaaaaaaaaaaaaaaaaaaaaaaaaaaaaagaaaaaaaaaaaaaaa

SEQ ID NO: 194 - DNA, 706 bp, Homo sapiens
  CDS 183..443
agaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagaaaaagcacaagaaagatggacacatggcagagtcttaaagtcaaagaagtattctgtaagcataattcttcctatgaatgccttctctataaagaggttgaagcaagacaggtttctaagacagccaccgatgggtcctacctcctcgtattcacatcctatgtaatctcctccccagtgtggactggacctggtgacttgcttccagtgaatagaatatagcaaaagtgattgatgtcacctccaagattcagctatagaagactatgactatgactttcctcttggctagcattctcgctaacccttcctgcttgcttgtactgagctgccctatgaagaggcccatgtagggtggcctgggtgggggtgatctgtggccaacagccagcaaggaactaaatcctgtttacaaccacatgagcttggaaggagatccttccccagtaaagccaggagatgaatacaaaaaaaaaaaaaaa

SEQ ID NO: 195 - DNA, 670 bp, Homo sapiens
  CDS 94..228
acttttcaggggacattcagaggcatcagccccttcctcctcaccagctcccagagttcccatctccatccccaatcctaaagaaggaaatcgatgccacggtcctcaaggagccctggggacccaggcgccctactcgaagatggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgcccagtcccaggtggaaggtatccctgggccctggcactgattataggacactgggcaagacactgcaccgccacgtgactcagtttccccatctgcctgatgggtgttgctgtgagaattatgaaatgaaatgatgaccatgaaaatattgtagaagccaagaaatgcttcagaagttataaagctctccccaaaccgtgttatgaaaaaaaaaaaaaaa

SEQ ID NO: 196 - DNA, 510 bp, Homo sapiens
  CDS 133..327
aacctcaaggagccctgttgtgctaccgactgcagagctcatggacatccatcaggaagcctccaatacccaaaccaggggtagttgcctaatccatatccatgtggatagctctttacttaggaaaccttgatggcttatttggatgacaaaggttcccttttggcgatacatagccatgcgagacaacatagccatgaaacaaaccaagtccaccagtggcttcctaggaacacatttgctttcctgataaaagaggacagatgcagttgcagaagtacctgtgcctctttttctttttcttcttctttttcttttttaatctcttaaatgcagatataagaactggtactgaagcagccatcttgtgaccataaggaagaagccaagaacatcagaaccagtggcctagccattgcacagtcatctaaacacacctctggacttgttattatgtaaaaaaaaataaacacctgctcttgttatttgcaatccaaaaaaaaaaaaaaa

SEQ ID NO: 197 - DNA, 500 bp, Homo sapiens
  CDS 22..357
atagaatatacacaaaaggaaatgagaaagaaatgtaaatgcttcactataaaaaaaacaaatacatacgaagaaagtaatgcaggaaatgaaggacaaaaagaagctataagcatttgtatttgcagaagagatggtttacttcctctgtgggtaaccaggttatcagatttggtgttttccaaagaaaaggcacatggcatgattccacttcttggctcccatagggaaaagaagacaagtaaagagatgaagacttcttccaggaacctgaggtacttcattgtctgcagagatgcctcatcctacacccctcagtcactcatatctggatacattggaccttgtcaacatcaataatggacatacctctgatatttgaactctgaatctcactctgtgaccacaactttgtatctttctaagtctttaatcttcaacctcacagaactcttcataccctaaaatatagtattttcacctggaaaaaaaaaaaaaaa

SEQ ID NO: 198 - DNA, 667 bp, Homo sapiens
  CDS 4..333
aaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcagatctctagctacctctacttaaatactgctcttgtggacttgcctggtgtggcggcctcccaggcatgtgactctcagcaggtgacttggcttctctacgttgctaatggtgcctactcggcatgtaacaggcctggatgaacggtagctgctgcggttacattattagcttcagtttgcccgcccaggctagatgtttaatcagatttcacagacttcacagtgtgagttggggatgtgacttcgtatgaaagtgaaggaactcaggctcagagagggtgagacgtaggagcatggccactgcgcgagctcggggctggctgtgggtttctccccattccctgcccatctgggaagtcgctgccaccccctacgcttgtctgctgactcccagtccccctaaccccccagaatgtaaacagcagcagatgaacaaaaataaaaatacaaaaggccgaaaaaaaaaaaaaaa

SEQ ID NO: 199 - DNA, 514 bp, Homo sapiens
  CDS 1..363
acgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgatttgcgtggactaggacacttaacctaagaagagtttcacttaatcattcaaatcactatctgaagggtcacggagcgcaaaataaagtttaaaaccctgctaccaaaaaaaaaaaaaaaaa

SEQ ID NO: 200 - DNA, 462 bp, Homo sapiens
  CDS 41..337
cttcaccaccaaaactctccactccaccagcacagccaaaatgctcgcacgtgctactttccgcgccgcctcggccccaactctcgtcgcccgccgcggcttccagtcgacccgcgcgcaaatggccagcccataccactaccccgagggtcctcgcagcaacttgccattcgacccgctgaagaagggctttgctttcaagtactggggctttatgggcaccggattcgcccttcccttcctccttgctgtctggcaaacagaacaagccgtaaatgcgctgagacacggcgtggacatgcgtatcgggatcccggggaacacggcatttgtagattaggtggagggcccgcatacggctatactagacatcacagcatcaatttcattgtctgtccccaaaaaaaaaaaaaaaaaaaaaaaaaaaaaaaaaaaaaaaaaaaaaaaaaaaaaaaaaaaaaa

SEQ ID NO: 201 - DNA, 551 bp, Homo sapiens
  CDS 1..549
agagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaaaaaaaaaaaaaa

SEQ ID NO: 202 - DNA, 550 bp, Homo sapiens
  CDS 34..315
  misc_feature 483: n=a, g, c or t
agagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgntactttctgatgtcatacccagtattccaagttcaccttgcctgcttcctaaaaaaaaaaaaaaaaa

SEQ ID NO: 203 - DNA, 408 bp, Homo sapiens
  CDS 1..315
atcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagcaaaaaaaaaaaaaaaaa

SEQ ID NO: 204 - DNA, 665 bp, Homo sapiens
  CDS 94..582
acttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgcaaaaaaaaaaaaaaa

SEQ ID NO: 205 - DNA, 1008 bp, Homo sapiens
  CDS 540..923
atttaggtgagctgccacgtccggaggagggcagcaagaatgaaagacctctagttttccagactcccggagccctggtctctacaccacatggacgttatccacctcctctgtgtcctcccaaggcagcatttcagaaggtgatccacggcaaagccgtcccttcaaatccgtctttgtgcccactgccatagtcaaccccgtgagaagcacagccggccctgggactttaggacaagggtctcttcggaaagggcggagcagcatgagaaagagtaagtggtggcagagagatggatccctgcagagacccctccagtccgggatccccactctcgtggtaggctccctcagacgcagccccaccatggtccttcggcctcagcagttccaattctaccagccacaggggatcacctcctccccctcagccgtggtggtggagatggggtccaagcctgccctcacgggggagcccgccctcacgtgcatcagcaggggcagtgaggcggatccactccgcggccagctccctcattatggaagacaaagaaatccccatcaagagtgagcctctgccaaaaccgcccgcatctgccccaccatccatcctggtgaaaccagaaaactcaagaaatggaatcgaaaagcaagtcaaaaccgtgagatttcagaattacagccctcctcccaccaaacattacacctcccatcccacctccggaaagcctgaacagccagccaccctcaaggcgtcccagcctgaagcagcgtccttgggcccagagatgaccgtcctatttgcccaccgaagtggctgccactccggacagcagacagacctccggagaaagtcagctcttgccaaggccacaaccctggtgtccactgcctcaggcacgcagaccgtgtttcccagcaaatgaacctacgggtggcttttcctagaccccaaagaggtgaattgcatttaaatacagtctgcctycactgaaaaaaaaaaaaaaa

SEQ ID NO: 206 - DNA, 455 bp, Homo sapiens
  CDS 77..364
tggacaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaagggggaggacaagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaaaaaaaaaaaaaaaaaaaaaaaaaaaaaaaaaaaaaaaaaaaaagaaaaaaaaaaaaaaa

SEQ ID NO: 207 - DNA, 749 bp, Homo sapiens
  CDS 65..544
cttttacgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcasgwgrtwttgctgctgaaggtgtggagtcagggacagccttcagtgacattaatctgcaggagaaggactgggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctacaaaaaaaaaaaaaaaaa

SEQ ID NO: 208 - DNA, 594 bp, Homo sapiens
  CDS 117..467
aaatgtagcctggtggtgttcccaggaggaaaagaacgagagactggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccatgttccttttacttatgtacatttttaataaaagaaagttgttaacgaaaaaaaaaaaaaaaaa

SEQ ID NO: 209 - DNA, 2098 bp, Homo sapiens
  CDS 893..1897
accaggtcctccgtggtgcacctgaaatggtcaacagaagtcttgtgacacgtggaatcatttcagagtcaccccttctgcctcctgctcaagcaacagacctgccgatcacccccgtcgggcccgcgtttctcagggtcttcctaatcccctgggctttccggcttgtcgtgtgcctggagtcaggccgccgtgcggcaggctgttaacctagcctcggggagagtgggatggagccaccttctcatggaacgatcctcgccttccctcatctccattgttttatggcttcacacggaccgtggctttctgcatggaagcttggtggccagggtgctgtcactttgggaagcagccagagaaccacaggatgcgtgaatcggtctccttgtcttcatgggcatctccggccagggtggtgtcttgtgctgtgattagtgggtcactggcaagtgtctgaatgaagtggaggttccggtggcaacagtgacggggaagggctatgggtccgcctcaatgtcatctgccccatccctgggcctccaggaatccagggtctcagcccctgctttagaaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggctcaaaaaaaaaaaaaaaaa

SEQ ID NO: 210 - DNA, 428 bp, Homo sapiens
  CDS 85..342
acactggtacagtcacctagcccatcagttccttcgtcgacagcgccggggacatccagactacaatttacagttcctctatccatgtgctgggttataaatcatgccatcctccctagaatgagaatgcacagcaagcggcagacaatcacccggcattcggcatctctttcttttcacgcgctccctcgctccgcctttctccagctctgccttctcaggcagatacatcagataccttgtttatccatcttcagctccactctgagggcgcagacgcacgattccgggatcgggtgcaccacggcgaasccaggcgggagacggcaggagcagctcaggtaaccaggggaagcttgcgtgcccacggagatgcagccgtggagctgtgaggaaagacggtctggcttcaaaaaaaaaaaaaaaaa

SEQ ID NO: 211 - DNA, 769 bp, Homo sapiens
  CDS 155..433
atttttccccccttgctcgggatggtgccacaggaggctgtgcgggccccgctccgcttcgaatggtggatgctgtggggcaccacctccttgaggaccaaggcactccagctgccaggaatttggctgctaacctcacacagctgagccttccatgaaaattgctctctgccaaagagaacttcctagtccaaggtcatgtctactctccagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtatgtgtcatgtctgtttgtttttcaattaagagaggaaagcattaggcagatggaatgtacatgtgaggatgaggagacagaaaacaagtagccctttccatcaagatagagggttttctggggttgctggctattgaatgtcactcctgatttctctttccaaggcactgtaccaccagcctactgagattgtgtgggagctttcatgggggttgtatttcactgatgaaaataaattttttgcataatgtgaaaaaaaaaaaaaaaaagaaaaaaaaaaaaaaaaa

SEQ ID NO: 212 - DNA, 914 bp, Homo sapiens
  CDS 63..386
ctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtgggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtacctgatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccaaaaaaaaaaaaaaaaa

SEQ ID NO: 213 - DNA, 1489 bp, Homo sapiens
  CDS 460..1290
cttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaacttcaaaaaaaaaaaaaaaaa

SEQ ID NO: 214 - DNA, 776 bp, Homo sapiens
  CDS 21..539
caaatatttccatcacggggatgcttgtcatgtacctgcttgccgccctctttggttacctaaccttctatggagaagttgaagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtmatatcaccaggcacctgcagaagaggaaaatcactgtttttgtcaaggatggttgtgtatgtgtttaaaataaaacctgtggtgcacaaaaaaaaaaaaaaaaa

SEQ ID NO: 215 - DNA, 1412 bp, Homo sapiens
  CDS 34..1143
atgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaaaaaaaaaaaaaaaa

SEQ ID NO: 216 - DNA, 1773 bp, Homo sapiens
  CDS 6..1184
ccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaaaaaaaaaaataaaaaaaaaaaaaaaaaa

SEQ ID NO: 217 - DNA, 1251 bp, Homo sapiens
  CDS 29..376
tatccggtcctcggctgcggcgggcaccatggtcggtggcgaggcggctgccgcagtggaggagctggtttcgggggtgcggcaggcggccgacttcgcggagcagttccgctcctactcagagagcgagaagcaatggaaggcccgcatggaattcatcctgcgccacctgcccgactaccgcgacccgcccgacggcagtggccgcctggaccagctgctctccctctccatggtctgggccaaccatctcttcctaggctgcagttacaataaagaccttttagacaaggtgatggaaatggccgatgggattgaagtggaagacctgccacaatttactaccagaagtgaattaatgaaaaagcatcaaagctaagccagaagatttatcacattttcatcatcagctacaggattagaaaggaggctgggatgaatgtgacatagaccacagcagctctcttaagactcctggtattaccaacataaagaggcaggtggaatgagaaggactctgtctagattggcttttttaacattctcattttcccaggagttatcactgtaaaagtatgcatggatatttatgtatttataaatcatgcactctaagatgagttcatcaacattgtaaaagccctcttttctgttttcaggtttttttttttcttatcgacaaggtctcactctgtcgcccaggcagaatcacaaaggtgcattattggctcattgcagcctcgaactcctgggctcatattttcagggttttttgttttttgttttgtttttttgagacagagtcttgctctgttgcccaggcagtagtgcmagtggcgcgatatattttcagtttttaaacgtcagaatttttgtttaaaatgcctttttgggctgggccacagtggccttatgcccataataatcccagcactttgggaggccgaggtgagcagatcacctgaggttaggagtttgagaccagcctggccaacacgatgaaaccccgtctctactaaaaatacaaacaaaattagctgggcatggtggcggacatctgtaatcccagctactcaggaggctgaagcagaagaactgcttgaacctgggaggtggaggttgcagtgagccaagatcgcaccattgcactccatcctgggcgacaaaaatgaaacaccgtctcaaaaaaaaaataaaaataataaaataaaatgcctttttgttgttgatgtgaaaaaaaaaaaaaaaaaa

SEQ ID NO: 218 - DNA, 894 bp, Homo sapiens
  CDS 78..566
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacctatttaaaaaaaaaaaaaaaaa

SEQ ID NO: 219 - DNA, 910 bp, Homo sapiens
  CDS 16..705
acatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaaatattcaataattcaatcaataaatataagtttcatcttacaccaaaaaaaaaaaaaaaaa

SEQ ID NO: 220 - DNA, 519 bp, Homo sapiens
  CDS 103..405
acttccggtgcgaaccgcctcggccgttccctcgcggagcttactgagcgcggccgccgagcccagctccgccgccgagcgcctgtgccggcacgbhacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtgbcgtgaaggcaaacaggattaaagtgaacatcacctttttatagcattaaattcattttttaaaatgataatgctggagggggccatctgatttgaataaagttgaaagaacatgtaaaaaaaaaaaaaaaaa

SEQ ID NO: 221 - DNA, 632 bp, Homo sapiens
  CDS 72..350
agtgagaccgcgcggcaacagcttgcggctgcggtagtcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagagaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccaaaaaaaaaaaaaaaaa

SEQ ID NO: 222 - DNA, 652 bp, Homo sapiens
  CDS 38..436
actgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcaaaaaaaaaaaaaaaaa

SEQ ID NO: 223 - DNA, 650 bp, Homo sapiens
  CDS 38..322
actgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcaaaaaaaaaaaaaaaaa

SEQ ID NO: 224 - DNA, 502 bp, Homo sapiens
  CDS 202..480
attctaaggctacaggtcctttggcaactgctccccctcttccttctccttttttttcaatctaatatgtgggacataccaagtgatgagatcctttctggcatcctaagaaaatgccaactatagaacaacagatgtagtctccttattaagtctgaagaccaaacttcttagtgcaaagcagtcaagtcttttctcaacatgaccccaatcaagcttttgaacttaacatcaagatataacttcagaagaacgtttggaatagagctcagttcaaactcttcctattgcaaacgaggaaatggctacagaagcagagtgcccaaagaatgcgaatgcaactggcttcatcttgaaagcgacactctgaagaaattacccataatttctccctcttggacatgcagaattatcctgttcttgtatttttctggccagcttctccaactttccctttcttgtttgcaactaattaaactttaaggataaaaaaaaaaaaaaa

SEQ ID NO: 225 - DNA, 1739 bp, Homo sapiens
  CDS 171..1670
actctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcaactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcatggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtagagagaataaagaaccattgcacatcttacatccacagtaatgagtcataatattatacaaattcagagtgttattaaagaggttttgaaataaaaaaaaaaaaaaa

SEQ ID NO: 226 - DNA, 657 bp, Homo sapiens
  CDS 199..618
aactggatagagtactgcccccttcagcccatggagaaaggcaaatgcctccttcagagtctacctaatgctttctcagataaataagcatgaagaaaagtcaaagtccattctagctctaaaataaggaatgaaatgttttcctgatatgattttttgttttcatctgataataattttatatatcacagaaacagcatggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggttgtgatcagaagcctcgtactgttcctacccttggaaacggcgcatgggatacctgccaacaacacatacgcacttcatcatggacagcaaacacactcgtcattcaaaaccagcattcacgggaaagcactgtttctgtttgcctttttatgttaatccgcatgcaacatattttgaaaacagatacacttcaacagttcagaatatgctagtactaataaaaccaacatgttaaaaaaaaaaaaaaa

SEQ ID NO: 227 - DNA, 888 bp, Homo sapiens
  CDS 182..481
attttgcctctcagtgttcaagcttgagcccacgcatccaactcctgagatcttactgggaagctgctgatcatcagtttcaggaagtcagcatggatcagccttacgttcatggcctccaggccctattctcctgcctcacagggaccggccaggatctctatccttacagcacgttggaatgtatatgctcctctccccacatcgccttagggagcaggcaggtgtcaggggcagcataaggacggccaacaggacagaagacgggttgaagatccgagaggctgagtcacttccacaaagtaacacagctgattttaaatgcctgcattcagcatccctgcagcaggctccaggtggaattctaatgggaccagcctccagtccctggaccttagccgtggaaggagagaagaggacatctgcacctcctctcagagaaagcctgatgcctactaaaggacttgggtggtggacgcagtgaccctcagtctggagcttgttcactgaacattggagactatcatttgcgcagatggtcttgggcctctatgagcagcaggctgcaccccacagtgacctcctcattctactctgaggcatcttcatgaaagcagatgtccattgaaaagcacccaagtgcagtctcagctgatgaacttcagaggcgattgagacaaaggctctcggtcccctctgcccttggatggtgcctctggtatgcacttggcctctgtgtctttatttagactggtcacttcacaacccatcatgtcaccccacccctaaccgtgcccactctgggtcctcccctcaactgcctgacttcccactttgagctcagcaaaggcaatagatgttttgtctgcttcgaaaaaaaaaaaaaaa

SEQ ID NO: 228 - DNA, 716 bp, Homo sapiens
  CDS 161..517
acctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtgggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaaccgggcctggcacaagtgaccatgggaagcagaagcaggggatttctgcctggaatatgtcattattagtagcatcatcatacacaagccatcagctttccaatccactgcttccttatctagaaattaaggatacagcacacattttacaggactgttctgagaaataatatatgcaaatatatgcatagtgcacaataaaaaaaaaaaaaaaa

SEQ ID NO: 229 - DNA, 654 bp, Homo sapiens
  CDS 86..505
agttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccagctcccagcccctccaaagatttactttcccatccgtgactcctggaatgcaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtcaaaaaaaaaaaaaaaaa

SEQ ID NO: 230 - DNA, 635 bp, Homo sapiens
  CDS 56..382
aattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagacagggtcccactgttgtccaggctggagtgcagtggcgggatctcggcttgctgcaacctccgactcctgggttcaagtgattcttatgcctcagcctcccgagtaactgggactacaggtgcacgtcaccacgcctgactagtttttgtatttttagtagagatgggattttactttgttggccaggctggtcttgaacccctggcctcaagtgatccacccaccttggcctcccaaagtgctgggattacaggtatgatcaaccacgcctggccatgtcatgccttgtgacagaattcctttattctgttttgagccaataaatatttataggtttcgaaaaaaaaaaaaaaaaa

SEQ ID NO: 231 - DNA, 634 bp, Homo sapiens
  CDS 56..355
aattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcgtgctattctgcacctgttgctgctgagccctttctcagtgggactagttcgaactatgtggaggagatgtactgtgcttggctggaaaaccccaaaagtgtacataagacagggtcccactgttgtccaggctggagtgcagtggcgggatctcggcttgctgcaacctccgactcctgggttcaagtgattcttatgcctcagcctcccgagtaactgggactacaggtgcacgtcaccacgcctgactagtttttgtatttttagtagagatgggattttactttgttggccaggctggtcttgaacccctggcctcaagtgatccacccaccttggcctcccaaagtgctgggattacaggtatgatcaaccacgcctggccatgtcatgccttgtgacagaattcctttattctgttttgagccaataaatatttataggtttcgaaaaaaaaaaaaaaaaa

SEQ ID NO: 232 - DNA, 583 bp, Homo sapiens
  CDS 76..498
aatatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgaaaaaaaaaaaaaaaaa

SEQ ID NO: 233 - DNA, 753 bp, Homo sapiens
  CDS 199..600
atttttccgatgccaggcaccctcaaggcacagaggctggggctcatgttgggggcacttggcctctccaggcctcgaaggcttctctgggctgatgcgagctggggaacgggagggacggacgtgggagcgagaacgtcacactggaggcagctggtggcacgatgggggacagagtgaaagagccttcgtgtcaccatggccacacaccccgatggcttccggcttgagggacccctggctgcagcccacagccctgggccttgcactgtgctctacgaaggccctgtccgtgggctctgcccytttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccactggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgcaaataaaaaaaaaaaaaaaaa

SEQ ID NO: 234 - DNA, 762 bp, Homo sapiens
  CDS 211..612
atttccgatgccaggcaccctcaaggcacagaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaaggtagcaagtcaagagccttcgtgtcaccatggccacacaccccgatggcttccggcttgagggacccctggctgcagcgcacagccctgggccttgcactgtgctctacgaaggccctgtccgtgggctctgcccctttgccccgcgaaattccaacaccatgtcggcggctgccctggctgcccccagcctgggcttcgatggggtgattggggtgctcgtggctgataccagcctcacggacatgcacgtggtggatgtagagctgagcggaccccggggccccacgtgccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgccaaaaaaaaaaaaaaaaa

SEQ ID NO: 235 - DNA, 537 bp, Homo sapiens
  CDS 5..259
aaaaatgctaaaggtagaagcaactggtagtcccgaggaagggtgggcgggtggagagccccggactggagctcctgcgaactccccttcctgccctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaaaaaa

SEQ ID NO: 236 - DNA, 994 bp, Homo sapiens
  CDS 23..370
gattgctgtttgctgtaaagtgatggggaggccctggatggtgatgatattggagtcaaaatctgaagaaaagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatggaaaaaaaaaaaaaaaaa

SEQ ID NO: 237 - DNA, 662 bp, Homo sapiens
  CDS 41..352
tagctaaaaattgagggttctaaatactaaggaagaagggatgaatagatattgtggcaagatatttgtctctgtcatggttaaattgcaaaaaaataaacttacctccttccccaggcagccattgttaacattttttgaatatctagaaaaagtcctttgttcaggattattttcccactctgccaagagtcaccatgacctgctcacacgccacccttatgaaactgccgcgccacttctcagctcccatttgattctcacagaagctctacgaaatgggttgggcaaatgtcatgatcctcatttcacaggggaagaaactgaggcccagagggggaaactgactacctaaaattgccatgtaggccggcgcggtggctcacgcctgtaatcccagcactgtgggaggccaaggcgggtggatcgcgaggtcaggagatcgagaccatcctggctggcacttgaagccccgtctctactagggatacaaataattggccgggtgtggtggcgggcgcctgtgkwcccagctgttcggcaggctgaggagggcgaatggtgtgagcctgggaggcggagcttgcggtgggccgggattgcgccactgcactccagcctgggcgacagagccagattccgtccaaaaaaaaaaaaaaaaa

SEQ ID NO: 238 - DNA, 1829 bp, Homo sapiens
  CDS 3..1319
atctaggtgaccatggatgggagctgagcttggaggaggacgcacagctgtggggtggggtggtgaagagttgttttgagggaaaaggcccacaaagagaagcccaaccagccagcccccaggccgccccgccaggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctcttggtaactgtgtcatgaagctgccggacagacacacgtggcatctccctgggcaggagagcaggcctgcagcatgggtcccgttcccgtgtgccgtgggtggcagtggctgcacctggcactagggctgctctgtggatgtgggtgacaacggcaggaggggacgctggccttcctgcacatagacctgcagttagtaaatcataagcccaaataaacaggttgtttgaatataaaaaaaaaaaaaaaaa

SEQ ID NO: 239 - DNA, 1083 bp, Homo sapiens
  CDS 421..768
aaggatgtgctctttcccaaggagagggagctctgttgcctccttcccacagaatcactctgtgcaaacctcttcccctccttggccccagtctccccaattctaaaatcggatactggataaaatgccacggaagaacctagggatgcaccaggaaccacgcgcctgaatgccacaggtttgatttgattcatgaccctcatctggacacaagctctaaaatacttgagccttggcagaaatggctgatagagtccacagaacacgctgtcctcatctcagagaggagaactctgaacccagaggggaaggatttacctgcagttgtatggcaagccagaggtaggcgctgcactggaacgcagcctaaccagcctaaagaaaccatgggaggagaggctcttaccctctcctttgcagatgtgggcccggctgcctcacactccagagcagatgggccacaggcttataggtcccaaggaagcttcacttcatgtggtacccagctggccagccaggaagatggaggggcttctggctggcctctcttcctctcctagaaagtcatgctggcccttttgggtccatgggccaaaggttcatgaaggtggctctgcctgtgagacatcaagctcctgggttgaaggacttggattaagaagagtgacatcagtgcacagtttatgccaagggcttggggcctcagtccagcttcttcctggaccaccaccaacaacaaccagtgataaaaataattatactagtggctgacatttatggattcttcctacacactaggctataccacagcgagtgcctcgaaaggaaatatagtatagcactgtgccgtccaacatggcggccactagccacatgcactactgagcacttgaaatgtggctagcccacattgagatgtgctgtaaataaagaatagacaccagatttccaagacttagtaccaaaaaaagaatgtaaaatttctcattaacaattttttttcttacatttattacatgttaacatgacgctatttggagtttaaataaatgcattattaaaattcaaaaaaaaaaaaaaaaa

SEQ ID NO: 240 - DNA, 1831 bp, Homo sapiens
  CDS 78..590
aaggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaataagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccggttggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggaggatgcacaggatgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctgaggtcaggagttcaagaccagcctggccaacacggtgaaaccccgtctctactaaaaaatacaaaaattagccaggtgtggtggctcacgcttatgtagtcccagttactcgggaggctgaggcacgagaatcacttgaacctgggaggcggaggttgcagtgagccgagatcgcgccactgcactccagcctgggcaacagagtgagactctgtctcaaaaaaaaaaaaaaaaa

SEQ ID NO: 241 - DNA, 1830 bp, Homo sapiens
  CDS 78..608
aaggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgataagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccggttggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggaggatgcacaggatgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctgaggtcaggagttcaagaccagcctggccaacacggtgaaaccccgtctctactaaaaaatacaaaaattagccaggtgtggtggctcacgcttatgtagtcccagttactcgggaggctgaggcacgagaatcacttgaacctgggaggcggaggttgcagtgagccgagatcgcgccactgcactccagcctgggcaacagagtgagactctgtctcaaaaaaaaaaaaaaaaa

SEQ ID NO: 242 - protein, 508 aa, Homo sapiens [sequence omitted]

SEQ ID NO: 243 - protein, 331 aa, Homo sapiens
  SIGNAL -31..-1
MWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLMEAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 244 - protein, 274 aa, Homo sapiens [sequence omitted]

SEQ ID NO: 245 - protein, 406 aa, Homo sapiens
  SIGNAL -35..-1
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 246 - protein, 24 aa, Homo sapiens
  SIGNAL -16..-1
MAPLGMLLGLLMAACTPSASVIRT

SEQ ID NO: 247 - protein, 348 aa, Homo sapiens
  SIGNAL -29..-1
MAPQSLPSSRMAPLGMLLGPLMAACFTFCLSHQNLKEFALTNPEKSSTKETERKETKAEEELDAEVLEVFHPTHEWQALQPGQAVPAGSHVRLNLQTGEREAKLQYEDKFRNNLKGKRLDINTNTYTSQDLKSALAKFKEGAEMESSKEDKARQAEVKRLFRPIEELKKDFDELNVVIETDMQIMVRLINKFNSSSSSLEEKIAALFDLEYYVHQMDNAQDLLSFGGLQVVINGLNSTEPLVKEYAAFVLGAAFSSNPKVQVEAIEGGALQKLLVILATEQPLTAKKKVLFALCSLLRHFPYAQRQFLKLGGLQVLRTLVQEKGTEVLAVRVVTLLYDLVTEKMFAEE

SEQ ID NO: 248 - protein, 397 aa, Homo sapiens
  SIGNAL -36..-1
MEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 249 - protein, 403 aa, Homo sapiens
  SIGNAL -21..-1
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSVSEYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGAGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 250 - protein, 111 aa, Homo sapiens
  SIGNAL -26..-1
MPHLMERMVGSGLLWLALVSCILTQASAVQRGYGNPIEASSYGLDLDCGAPGTPEAHVCFDPCQNYTLLDLGPITRRGAQSPGVMNGTPSTAGFLVAWPMVLLTVLLAWLF

SEQ ID NO: 251 - protein, 72 aa, Homo sapiens
  SIGNAL -17..-1
MDRPGFVAALVAGGVAGVSVDLILFPLDTIKTRLQSPQGFNKAGGFHGIYAGVPSAAIGSFPNGCLPDSSSI

SEQ ID NO: 252 - protein, 138 aa, Homo sapiens
  SIGNAL -15..-1
MKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 253 - protein, 108 aa, Homo sapiens
  SIGNAL -31..-1
  UNSURE 45: Xaa = Glu,Gln
  UNSURE 44: Xaa = Lys,Asn
MWLWEDQGGLLGPFSFLLLVLLLVTRSPVNACLLTGSLFVLLRVFSFEPVPSCRALQVLKPRDRISAIAHRGGSXXAPENTLAAIRQLRMEQQAWSWTLSLLLTGFLS

SEQ ID NO: 254 - protein, 147 aa, Homo sapiens
  SIGNAL -24..-1
MVMGLGVLLLVFVLGLGLTPPTLAQDNSRYTHFLTQHYDAKPQGRDDRYCESIMRRRGLTSPCKDINTFIHGNKRTIKAICENKNGNPHRENLRISKSSFQVTTCKLHGGSPWPPCQYRATAGFRNVVVACENGLPVHLDQSIFRRP

SEQ ID NO: 255 - protein, 381 aa, Homo sapiens
  SIGNAL -33..-1
MSWTVPVVRASQRVSSVGANFLCLGMALCPRQATRIPLNGTWLFTPVSKMATVKSELIERFTSEKPVHHSKVSIIGTGSVGMACAISILLKGLSDELALVDLDEDKLKGETMDLQHGSPFTKMPNIVCSKDYFVTANSNLVIITAGARQEKGETRLNLVQRNVAIFKLMISSIVQYSPHCKLIIVSNPVDILTYVAWKLSAFPKNRIIGSGCNLDTARFRFLIGQKLGIHSESCHGWILGEHGDSSVPVWSGVNIAGVPLKDLNSDIGTDKDPEQWKNVHKEVTATAYEIIKMKGYTSWAIGLSVADLTESILKNLRRIHPVSTIIKGLYGIDEEVFLSIPCILGENGITNLIKIKLTPEEEAHLKKSAKTLWEIQNKLKL

SEQ ID NO: 256 - protein, 139 aa, Homo sapiens
  SIGNAL -33..-1
MSWTVPVVRASQRMSSVGANFLCLGMALCLRQATRIPLNGTWLFTPVSKMATVKSELIERFTSEKPVHHSKVSIIGTGSVGMACAISILLKGLSDELALVDLDEDKLKGETMDLQHGSPFTKMPILFVAKITLSQQTPT

SEQ ID NO: 257 - protein, 265 aa, Homo sapiens
  SIGNAL -14..-1
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNGSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 258 - protein, 200 aa, Homo sapiens
  SIGNAL -20..-1
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 259 - protein, 394 aa, Homo sapiens
  SIGNAL -39..-1
MATAQLQRTPMSALVFPNKISTEHQSLVLVKRLLAVSVSCITYLRGIFPECAYGTRYLDDLCVKILREDKNCPGSTQLVKWILGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 260 - protein, 158 aa, Homo sapiens
  SIGNAL -17..-1
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 261 - protein, 233 aa, Homo sapiens
  SIGNAL -32..-1
MATPPFRLIRKMFSFKVSRWMGLACFRSLAASSPSIRQKKLMHKLQEEKAFREEMKIFREKIEDFREEMWTFRGKIHAFRGQILGFWEEERPFWEEEKTFWKEEKSFWEMEKSFREEEKTFWKKYRTFWKEDKAFWKEDNALWERDRNLLQEDKALWEEEKALWVEERALLEGEKALWEDKTSLWEEENALWEEERAFWMENNGHIAGEQMLEDGPHNANRGQRLLAFSRGRA

SEQ ID NO: 262 - protein, 67 aa, Homo sapiens
  SIGNAL -20..-1
MDSSTAHSPVFLVFPPEITASEYESTELSATTFSTQSPLQKLFARKMKILGDIHSGALFCSLILEPS

SEQ ID NO: 263 - protein, 94 aa, Homo sapiens
  SIGNAL -25..-1
MCFLVSFNLPIHISLSHLFLDLSRSLWFLACPGLNLVYLALDSFSDLRPSLNLLFYFVPGFGVSKYLTSAQPVLGFLLLPDIDNPALLGTERWS

SEQ ID NO: 264 - protein, 174 aa, Homo sapiens
  SIGNAL -19..-1
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEEPHVEPAGERELEAKARPQSSCDMEEKEEAAADQ

SEQ ID NO: 265 - protein, 106 aa, Homo sapiens
  SIGNAL -17..-1
MALEVLMLLAVLIWTGAENLHVKISCSLDWLMVSVIPVAESRNLYIFADELHLGMGCPANRIHTYVYEFIYLVRDCGIRTRVRTVIVCKKYCMFCQTFMPSIKIVF

SEQ ID NO: 266 - protein, 124 aa, Homo sapiens
  SIGNAL -18..-1
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 267 - protein, 261 aa, Homo sapiens [sequence omitted]

SEQ ID NO: 268 - protein, 76 aa, Homo sapiens
  SIGNAL -25..-1
MCMSLSMKVPCCLCALLSNFCPSTTVKGDVVTSFFRADYDLASRSADQSSQKVKLRMFTGRLPIGPFASVGNAAEL

SEQ ID NO: 269 - protein, 199 aa, Homo sapiens
  SIGNAL -16..-1
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 270 - protein, 88 aa, Homo sapiens
  SIGNAL -36..-1
MASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 271 - protein, 481 aa, Homo sapiens
  SIGNAL -25..-1
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSDSSGRPTVTASSCSSDIADVEVDMSGDLGWLLNLFHNQIESKFQKVLESRICEMIQKSVSSDLQPYLQTLTVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 272 - protein, 143 aa, Homo sapiens
  SIGNAL -43..-1
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTRHGHIALSRTA

SEQ ID NO: 273 - protein, 82 aa, Homo sapiens
MAKYQGEVQSLKLDDDSVIEGVSDQVLVAVVVSFALIATLVYALFRNVHQNIHPENQELVRVLREQLQTEQDAPADSTAVLH

SEQ ID NO: 274 - protein, 373 aa, Homo sapiens
  SIGNAL -27..-1
MATQAHSLSYAGCNFLCQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQIDPSVDVLKATALPLLKQFGIDGESFELKIVRRGMPPGGGGEVVFSCPVRKVLKPIQLTDPGKIKRIRGMAYSVRVSPQMANRIVDSARSILNKFIPDIYIYTDHIKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSRTLK

SEQ ID NO: 275 - protein, 94 aa, Homo sapiens
  SIGNAL -25..-1
MASVVLALRTRTAVTSLLSPTPATALAVRYASKKSGGSSKNLGGKSSGRRQGIKKMEGHYVHAGNIIATQRHFRWHPGAHVSCSVAAPLFPFLG

SEQ ID NO: 276 - protein, 197 aa, Homo sapiens
  SIGNAL -20..-1
MTVLEITLAVILTLLGLAILAILLTRWARRKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTLGPIVQYPGSNGRINISQLTSEDLTGAKGRVTSGPQFPNSHHVPENLHGYMNSLSLFSPA

SEQ ID NO: 277 - protein, 344 aa, Homo sapiens
  SIGNAL -29..-1
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 278 - protein, 541 aa, Homo sapiens
  SIGNAL -28..-1
MGSQEVLGHAARLSSSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKTVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 279 - protein, 267 aa, Homo sapiens
  SIGNAL -24..-1
MARFLTLCTWLLLLGPGLLATVRAECSQDCATCSYRLVRPADINFLACVMECEGKLPSLKIWETCKELLQLSKPDLPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 280 - protein, 362 aa, Homo sapiens
  SIGNAL -40..-1
MPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLYLVKTFTAAVRAELIRAFGLDRLPLPVSGFPQASRKTQHQ

SEQ ID NO: 281 - protein, 81 aa, Homo sapiens
  SIGNAL -21..-1
MSRSSKVVLGLSVLLTAATVAGVHVKQQWDQQRLRDGVIRDIERQIRKKENIRLLGEQIILTEQLEAEREKMLLAKGSQKS

SEQ ID NO: 282 - protein, 541 aa, Homo sapiens
  SIGNAL -28..-1
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDINGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 283 - protein, 468 aa, Homo sapiens
  SIGNAL -21..-1
MGTQEGWCLLLCLALSGAAETKPHPAEGQWRAVDVVLDCFLVKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANVQVSGGGPSISLVMKTPRVAKNEVLWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 284 - protein, 406 aa, Homo sapiens
  SIGNAL -31..-1
MVRIQRRKLLASCLCVTATVFLLVTLQALDTVENLMKVTGPPQGVTDSMQCFNDQWPLSNTRSSEHIKEVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSYCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGRSLTSDF

SEQ ID NO: 285 - protein, 305 aa, Homo sapiens
  SIGNAL -26..-1
MGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 286 - protein, 442 aa, Homo sapiens
  SIGNAL -21..-1
  UNSURE 132: Xaa = Pro,Arg
MGTQEGWCLLLCLALSGAAETKPHPAEGQLRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGXSISLVMKTPRVTKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAER

SEQ ID NO: 287 - protein, 286 aa, Homo sapiens
  SIGNAL -48..-1
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 288 - protein, 398 aa, Homo sapiens
  SIGNAL -21..-1
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 289 - protein, 130 aa, Homo sapiens
  SIGNAL -20..-1
MRQKAVSLFFCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 290 - protein, 86 aa, Homo sapiens
  SIGNAL -20..-1
MAVGGGLAVAGLPALGFTGAGIAANSVAASLMSWSAILNGGGVPAGGLVATLQSLGAGGSSVVIGNIGALMGYATHKYLDSEEDEE

SEQ ID NO: 291 - protein, 207 aa, Homo sapiens
  SIGNAL -23..-1
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSFPCKLQSGTHCLWTDQLLQGSEKGFQSRHLACLPREPGLCTWQSLRSQIA

SEQ ID NO: 292 - protein, 111 aa, Homo sapiens
  SIGNAL -24..-1
MKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMVRFNI

SEQ ID NO: 293 - protein, 139 aa, Homo sapiens
  SIGNAL -15..-1
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 294 - protein, 160 aa, Homo sapiens
  SIGNAL -27..-1
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 295 - protein, 181 aa, Homo sapiens
  SIGNAL -16..-1
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGREYLPCALFLHQQGHRWSPKVPNYRICSYSGNYISI

SEQ ID NO: 296 - protein, 247 aa, Homo sapiens
  SIGNAL -18..-1
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCRASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGLPRAPTIVLVGSLASTAAITSRMLGWTTWARW

SEQ ID NO: 297 - protein, 132 aa, Homo sapiens
  SIGNAL -41..-1
MEGGAYGAGKAGGAFDPYTLVRQPHTILRVVSWLFSIVVFGSIVNEGYLNSASEGEQFCIYNRNPNACSYGVAVGVLAFLTCLLYLALDVYFPQISSVKDRKKAVLSDIGVSGEPHPAGTPCTESTEGCPGP

SEQ ID NO: 298 - protein, 251 aa, Homo sapiens
  SIGNAL -24..-1
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 299 - protein, 137 aa, Homo sapiens
  SIGNAL -22..-1
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 300 - protein, 541 aa, Homo sapiens
  SIGNAL -28..-1
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECLTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCDQGWPARLAHIAVGAFCLGATLGTAFLTETKLIHFLRTQLGVPRRTDKMT

SEQ ID NO: 301 - protein, 287 aa, Homo sapiens
  SIGNAL -17..-1
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQDLPRRLRGPQKDELKSFILQKYMMVDSAEDQKIHRPMAPKEAPKKLIRYIDNQVVSTKGERFKDVRNPEAEEMKATYINLKPARKYRFH

SEQ ID NO: 302 - protein, 165 aa, Homo sapiens
  SIGNAL -35..-1
MMRCCRRRCCCRQPPHALRPLLLLPLVLLPPLAAAAAGPNRCDTIYQGFAECLIRLGDSMGRGGELETICRSWNYFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 303 - protein, 148 aa, Homo sapiens
  SIGNAL -25..-1
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 304 - protein, 291 aa, Homo sapiens
  SIGNAL -34..-1
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 305 - protein, 81 aa, Homo sapiens
  SIGNAL -49..-1
MEGAGAGSGFRKELVSRLLHLHFKDDKTKVSGDALQLMVELLKVFVVEAAVRGVRQAQAEDALRVDVDQLEKVLPQLLLDF

SEQ ID NO: 306 - protein, 233 aa, Homo sapiens
  SIGNAL -30..-1
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDKTDKGGEKGKEADKEINKSGEKAM

SEQ ID NO: 307 - protein, 85 aa, Homo sapiens
  SIGNAL -20..-1
MRQKAVSLFLCYLLLFTCSGVEAGKKKCSESSDSGSGFWKALTFMAVGGGLAVAGLPALGFTGAGIAANSVAASLMSWSAILNGG

SEQ ID NO: 308 - protein, 105 aa, Homo sapiens
  SIGNAL -43..-1
MGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 309 - protein, 291 aa, Homo sapiens
  SIGNAL -34..-1
MESERSKRMGNACIPLKRIAYFLCLLSALLLTEGKKPAKPKCPAVCTCTKDNALCENARSIPRTVPPDVISLSFVRSVFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 310 - protein, 426 aa, Homo sapiens
  SIGNAL -28..-1
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSMQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 311 - protein, 466 aa, Homo sapiens
  SIGNAL -16..-1
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 312 - protein, 382 aa, Homo sapiens
  SIGNAL -16..-1
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAASSSEPCATRSLSLPCSGSSTPRAPSARRRMKTWCEMRCSRTRAPSG

SEQ ID NO: 313 - protein, 258 aa, Homo sapiens
  SIGNAL -36..-1
MEELQEPLRGELRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPPPTRPDQSGFTRGRRLGARR

SEQ ID NO: 314 - protein, 280 aa, Homo sapiens
  SIGNAL -33..-1
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPLINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 315 - protein, 174 aa, Homo sapiens
  SIGNAL -33..-1
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSP

SEQ ID NO: 316 - protein, 160 aa, Homo sapiens
  SIGNAL -17..-1
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNPDTLSYCQKEAWCKLAFYLLSFFYYLYCMIYTLVSS

SEQ ID NO: 317 - protein, 426 aa, Homo sapiens
  SIGNAL -28..-1
MSPAFRAMDVEPRAKGVLLEPFVHQVGGHSCVLRFNETTLCKPLVPREHQFYETLPSEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 318 - protein, 301 aa, Homo sapiens
  SIGNAL -20..-1
MARHGLPLLPLLSLLVGAWLKLGNGQATSMVQLQGGRFLMGTNSPDSRDGEGPVREATVKPFAIDIFPVTNKDFRDFVREKKYRTEAEMFGLSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 319 - protein, 119 aa, Homo sapiens [sequence omitted]

SEQ ID NO: 320 - protein, 95 aa, Homo sapiens
  SIGNAL -39..-1
MDYSRVFQGVFFTFKHAFADGAWDLSFLCALCSFCPISAASGRPYRYLEFWRLYLSPSSMENGVQKFHETFFIVFLLLFDIERKGKSSVCPFCYR

SEQ ID NO: 321 - protein, 191 aa, Homo sapiens
  SIGNAL -39..-1
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICPSCSLWLAVASFQRLLLRGLICLFVC

SEQ ID NO: 322 - protein, 89 aa, Homo sapiens [sequence omitted]

SEQ ID NO: 323 - protein, 70 aa, Homo sapiens
  SIGNAL -38..-1
MSSPQLPAFLWDKGTLTTAISNPACLVNVLFFFTPLMTLVTLLILVWKVTKDKSNKNRETHPRKEATWLP

SEQ ID NO: 324 - protein, 168 aa, Homo sapiens
  SIGNAL -25..-1
MRGPTAGPSVLSAAHLLVVILPANAALKLLSWERLAAPAIEVEVPSKEVLAAPTKAKLIPSEDMLAAPAMDLLDSFSPGFLIAAPASAVITWPGPADLVVAMLIAPVAGLIAAPAIATSVLGPVAVPATAMPPAVLAAPPSAAPGVLVDGEAALAVPWEACWIPSPPA

SEQ ID NO: 325 - protein, 166 aa, Homo sapiens
  SIGNAL -15..-1
MLPLLIICLLPAIEGKNCLRCWPELSALIDYDLQILWVTPGPPTELSQNRDHLEEETAKFFTQVHQAIKTLRDDKTVLLEEIYTHKNLFTERLNKISDGLKEKDIQSTLKVTSCADCRTHFLSCNDPTFCPARNRRTSLWAVSLSSALLLAIAGDVSFTGKGRRRQ

SEQ ID NO: 326 - protein, 156 aa, Homo sapiens
  SIGNAL -15..-1
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 327 - protein, 105 aa, Homo sapiens
  SIGNAL -32..-1
MAKMFDLRTKIMIGIESSLLVAAMVLLSVVFCLYFKVAKALKAAKDPDAVAVKNHNPDKVCWATNSQAKATTMESCPSLQCCEGCRMHASSDSLPPCCCDINEGL

SEQ ID NO: 328 - protein, 81 aa, Homo sapiens
  SIGNAL -27..-1
MSDEDESSDYLCLSILGLFCCLPLAIPAVIFSCLTKNYNKSSDYELAAKTSKQAYYWAIASITVGILGTILYTYLIYLLRL

SEQ ID NO: 329 - protein, 95 aa, Homo sapiens
  SIGNAL -27..-1
MTDQDRIINLVVGSLTSLLILVTLISAFVFPQLPPKPLNIFFAVCISLSSITACIIYWYRQGDLEPKFRKLIYYIIFSIIMLCICANLYFHDVGR

SEQ ID NO: 330 - protein, 84 aa, Homo sapiens
  SIGNAL -20..-1
MAAAAVPSLLLSLPPHQGLTFSNKIQPFGAQGVLHPEPGLRDWLLPTCSRQLRVALPEKGSEGSLCQTQLPATPCFLPSNTVRT

SEQ ID NO: 331 - protein, 124 aa, Homo sapiens
  SIGNAL -32..-1
MVVVEPGASLFPNGVPWLYAVFAVLFVFFLFAMLSPFLLEIDQHIKKFLIRCRYSLHNTVHKDKKNSEIKMDHLERPGCPLESPRRGVLGGKKNGMGNDPLLFVKVTKEPRDSEAEIYTPGPSV

SEQ ID NO: 332 - protein, 62 aa, Homo sapiens
  SIGNAL -46..-1
MDQLVFKETIWNDAFWQNPWDQGGLAVIILFITAVLLLILFAIVFGLLTSTENTQCEAGEEE

SEQ ID NO: 333 - protein, 150 aa, Homo sapiens
  SIGNAL -23..-1
MSNQRLPLIFSLLFICFFGESFCICDGTVWTKVGWEILPEEVHYWKGCLYLIYNLLQAVFFVLFVLSVHYLWKKWKKHQKKLKKQASLEKPGNDLESPLINNIDQTLHRVATTASVIYKIWEHRSHHPSSKKIKHCKLKKKSKEEGARRY

SEQ ID NO: 334 - protein, 198 aa, Homo sapiens
  SIGNAL -13..-1
MLLGRLTSQLLRAVPWAGGRPPWPVSGVLGSRVCGPLYSTSPAGPGRAASLPRKGAQLELEEMVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIKFEKDLRRIWLKAGLKEAPEGWQTPKIYLRGK

SEQ ID NO: 335 - protein, 88 aa, Homo sapiens
  SIGNAL -24..-1
MVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 336 - protein, 150 aa, Homo sapiens
  SIGNAL -45..-1
MVLMWTSGDAFKTAYFLLKGAPLQFSVCGLLQVLVDLAILGQAYAFAPPPEAGAPRRAPHWHQGPLTVGRTRMWDRQPRALVGPDLPAGRVGAVAPAGVAEMGHGHWGLHQPLWGVSGWAVGVGLGRCLCSAGTARVDLAPRVLDVFRMT

SEQ ID NO: 337 - protein, 142 aa, Homo sapiens
  SIGNAL -19..-1
MATASPSVFLLMVNGQVESAQFPEYDDFYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 338 - protein, 112 aa, Homo sapiens
  SIGNAL -27..-1
  UNSURE 21: Xaa = Ala,Pro
TSEERTAMKREGGAAHLCSDSLPESQQQDGNHAPNFSSHGSCRRRQRXDMTRRCMPARPGFPSSPAPGSSPPRCHLRPGSTAHAAAGKRTESPGDRYRAEGLRRGRVAGARV

SEQ ID NO: 339 - protein, 90 aa, Homo sapiens
  SIGNAL -32..-1
MPCLDQQLTVHALPCPAQPSSLAFCQVGFLTAQPSPPRRRNGKDRYTLVLQHQECQDDLATSSLVYLSLPCFKDLGRSKHQSITVADTNK

SEQ ID NO: 340 - protein, 80 aa, Homo sapiens
  SIGNAL -35..-1
MPFQFGTQPRRFPVEGGDSSIELEPGLSSSAACNGKEMSPTRQLRRCPGSHCLTITDVPVTVYATTRKPPAQSSKEMHPK

SEQ ID NO: 341 - protein, 131 aa, Homo sapiens
  SIGNAL -15..-1
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVACK

SEQ ID NO: 342 - protein, 99 aa, Homo sapiens
  SIGNAL -39..-1
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 343 - protein, 98 aa, Homo sapiens
  SIGNAL -43..-1
MCETLLTSKWASVSPIPALLQEGENRDSRRLGDALLFLRPAGSCALQVSWPAALAGPRSHTGQLTQHFCHLKNDTCIPPSLGPPRNSGSLESLRSKRY

SEQ ID NO: 344 - protein, 217 aa, Homo sapiens
  SIGNAL -19..-1
  UNSURE 185: Xaa = Phe,Val
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGRLLPCLLGVGSWLLFNNWTGGSWFSLHLQQVSLSQGSHVAAFLPEAIGPGVPVPVSGESTSAQQSHAGWQLSAEADACPSVLYSEVLEWNKNINTYTSFHDFCLILGIFXVLFCFGGDRLTLH

SEQ ID NO: 345 - protein, 183 aa, Homo sapiens
  SIGNAL -20..-1
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 346 - protein, 247 aa, Homo sapiens [sequence omitted]

SEQ ID NO: 347 - protein, 104 aa, Homo sapiens
  SIGNAL -47..-1
MFSPRQALTPDPLHSPAYSPVLGGWSRFRSVDFRFLYLTLNQSCIFANYKEAHANRYCTEGRYTREIQRLTSPAAWPTRDKNRMISNGMALNSPAEGLAFQCRF

SEQ ID NO: 348 - protein, 125 aa, Homo sapiens
  SIGNAL -21..-1
MAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 349 - protein, 302 aa, Homo sapiens
  SIGNAL -18..-1
MAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 350 - protein, 107 aa, Homo sapiens [sequence omitted]

SEQ ID NO: 351 - protein, 229 aa, Homo sapiens
  SIGNAL -34..-1
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 352 - protein, 206 aa, Homo sapiens
  SIGNAL -34..-1
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGSRAFFLSTEKKNLETK

SEQ ID NO: 353 - protein, 88 aa, Homo sapiens
  SIGNAL -44..-1
MAAEGWIWRWGWGRRCLGRPGLLGPGPGPTTPLFLLLLLGSVTADITDGNIEHLKREHSLIKPYQGVGSSSPSGTSRAALCSRASTYV

SEQ ID NO: 354 - protein, 151 aa, Homo sapiens
  SIGNAL -32..-1
MDSASNPTNLVSTSQRHRPLLSSCGLPPSTASAVRRLCSRGVLKGSNERRDMESFWKLNRSPGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 355 - protein, 65 aa, Homo sapiens [sequence omitted]

SEQ ID NO: 356 - protein, 189 aa, Homo sapiens
  SIGNAL -24..-1
  UNSURE 41: Xaa = Ala,Gly
MEEGGNLGGLIKMVHLLVLSGAWGMQMWVTFVSGFLLFRSLPRHTFGLVQSKLFPFYFHISMGCXFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 357 - protein, 183 aa, Homo sapiens
  SIGNAL -47..-1
MTECTSLQFVSPFAFEAMQKVDVVCLASLSDPELRLLLPCLVRMALCAPADQSQSWAQDKKLILRLLSGVEAVNSIVALLSVDFHALEQDASKEQQLRPSLALLPRLECGGVISAHCNLHLLGSSDSSASVSRVDGTTGTRHHARLFCIISRDEVSPYWPGWSRTPNLVIHLPQPPKVLGLPA

SEQ ID NO: 358 - protein, 102 aa, Homo sapiens
  SIGNAL -14..-1
MFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 359 - protein, 244 aa, Homo sapiens
  SIGNAL -29..-1
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 360 - protein, 177 aa, Homo sapiens
  SIGNAL -23..-1
MSNQRLPLIFSLLFICFFGESFCICDGTVWTKVGWEILPEEVHYWKVKGSPSHCLPYLLDKLCCDFANMDIFQGCLYLIYNLLQAVFFVLFVLSVHYLWKKWKKHQKKLKKQASLEKPGNDLESPLINNIDQTLHRVATTASVIYKIWEHRSHHPSSKKIKHCKLKKKSKEEGARRY

SEQ ID NO: 361 - protein, 158 aa, Homo sapiens
  SIGNAL -21..-1
MALCALTRALPSLNLAPPTVAAPAPSLFPAAQMMNNGLLQQPSALMLLPCRPVLTSVALNANFVSWKSRTKYTITPVKMRKSGGRDHTGAGNVRRTVGRVSNVDHNKRVIGKAGRNRWLGKRPNSGRWHRKGGWAGRKIRPLPPMKSYVKLPSASAQS

SEQ ID NO: 362 - protein, 186 aa, Homo sapiens
  SIGNAL -19..-1
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAITAPRKAVFSVHGLTSPRALALVHIKGT

SEQ ID NO: 363 - protein, 150 aa, Homo sapiens
  SIGNAL -47..-1
MGDRVKGSKSRAFVSPWPHTPMASGLRDPWLQPTALGLALCSTKALSVGSAPLPPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 364 - protein, 95 aa, Homo sapiens [sequence omitted]

SEQ ID NO: 365 - protein, 94 aa, Homo sapiens [sequence omitted]

SEQ ID NO: 366 - protein, 140 aa, Homo sapiens
  SIGNAL -40..-1
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 367 - protein, 39 aa, Homo sapiens
  SIGNAL -35..-1
MDPGWPHFKLTHSRCMAVLFLGTLPLCPVTSPVWGWSPG

SEQ ID NO: 368 - protein, 78 aa, Homo sapiens
  SIGNAL -41..-1
MSASVVSVISRFLEEYLSSTPQRLKLLDAYLLYILLTGALQFGYCLLVGTFPFNSFLSGFISCVGSFILAGSLFEFPG

SEQ ID NO: 369 - protein, 83 aa, Homo sapiens
  SIGNAL -40..-1
MGLTSTWRYGRGPGIGTVTMVSWGRFICLVVVTMATLSLARPSFSLVEDTTLEPEDAISSGDDEDDTDGAEDFVSENSNNKSK

SEQ ID NO: 370 - protein, 92 aa, Homo sapiens [sequence omitted]

SEQ ID NO: 371 - protein, 279 aa, Homo sapiens
  SIGNAL -42..-1
MAAPVRRTLLGVAGGWRRFERLWAGSLSSRSLALAAAPSSNGSPWRLLGALCLQRPPVVSKPLTPLQEEMASLLQQIEIERSLYSDHELRALDENQRLAKKKADLHDEEDEQDILLAQDLEDMWEQKFLQFKLGARITEADEKNDRTSLNRNLDRNLVLLVREKFGDQDVWILPQAEWQPGETLRGTAERTLATLSENNMEAKFLGNAPCGHYTFKFPQAMRTESNLGAKVFFFKALLLTGDFSQAGNKGHHVWVIKDELGDYLKPKYLAQVRRFVSDL

SEQ ID NO: 372 - protein, 184 aa, Homo sapiens [sequence omitted]

SEQ ID NO: 373 - protein, 101 aa, Homo sapiens [sequence omitted]

SEQ ID NO: 374 - protein, 85 aa, Homo sapiens [sequence omitted]

SEQ ID NO: 375 - protein, 90 aa, Homo sapiens
  SIGNAL -28..-1
MAFPGQSDTKMQWPEVPALPLLSSLCMAMVRKSSALGKEVGRRVKEMVMLVAPFRQSSSLSRTFSSRKVVKAHASLHGARLSPLSRNIRG

SEQ ID NO: 376 - protein, 89 aa, Homo sapiens
  SIGNAL -33..-1
  UNSURE 47: Xaa = Ala,Pro,Ser,Thr
MAQPAAPSLTRPFLAEAPTALVPHSPLPGALSSAPGPKQPPTASTGPELLLLPLSSFMPCGAAAPARVSSQRATPRDKPXGPLIPGQCP

SEQ ID NO: 377 - protein, 132 aa, Homo sapiens
  SIGNAL -15..-1
MNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 378 - protein, 102 aa, Homo sapiens
  SIGNAL -14..-1
  UNSURE 50: Xaa = Ala,Gly
  UNSURE 51: Xaa = Leu,Met,Val
MFLTALLWRGRIPGRQWIGKHRRPRFVSLRAKQNMIRRLEIDAENHYWLSMPYMTREQERGHAXXRRREAFEAIKAAATSKFPPHRFIADQLDHLNVTKKWS

SEQ ID NO: 379 - protein, 504 aa, Homo sapiens
  SIGNAL -24..-1
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYSFYLPFFFFGPIMTFDRFHAQVSQVEPVRREGELWHIRAQAGLSVVAIMAVDIFFHFFYILTIPSDLKFANRLPDIALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 380 - protein, 152 aa, Homo sapiens
  SIGNAL -26..-1
MVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDIW

SEQ ID NO: 381 - protein, 51 aa, Homo sapiens [sequence omitted]

SEQ ID NO: 382 - protein, 72 aa, Homo sapiens
  SIGNAL -23..-1
MLRPALPWLYLGLCSLLVGEAEAPSPVDPLERSRPYAVLRGQNLVLMGTIFSILLVTVILMAFCVYKPIRRR

SEQ ID NO: 383 - protein, 95 aa, Homo sapiens
  SIGNAL -48..-1
MASSHWNETTTSVYQYLGFQVQKIYPFHDNWNTACFVILLLFIFTVVSLVVLAFLYEVLDCCCCVKNKTVKDLKSEPNPLRSMMDNIRKRETEVV

SEQ ID NO: 384 - protein, 150 aa, Homo sapiens [sequence omitted]

SEQ ID NO: 385 - protein, 354 aa, Homo sapiens
MSAGGGRAFAWQVFPPMPTCRVYGTVAHQDGHLLVLGGCGRAGLPLDTAETLDMASHTWLALAPLPTARAGAAAVVLGKQVLVVCGVDEVQSPVAAVEAFLMDEGRWERRATLPQAAMGVATVERDGMVYALGGMGPDTAPQAQVRVYDPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 386 - protein, 207 aa, Homo sapiens
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGPVVPAFALWDGELLTHSGLEVPEGL

SEQ ID NO: 387 - protein, 210 aa, Homo sapiens
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 388 - protein, 375 aa, Homo sapiens
MAVTEASLLRQCPLLLPQNRSKTVYEGFISAQGRDFHLRIVLPEDLQLKNARLLCIWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 389 - protein, 509 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTTDDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 390 - protein, 78 aa, Homo sapiens
MYNTGRHVSLRLDKEHLVNISGGPMTYSHRLEEIRLHFGSEDSQGSEHLLNGQAFSGELQERDLFILLTSVSGHLPDT

SEQ ID NO: 391 - protein, 162 aa, Homo sapiens
MATHALEIAGLFLGGVGMVGTVAVTVMPQWIVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNPIVNVAQKRELG

SEQ ID NO: 392 - protein, 146 aa, Homo sapiens
MNSLLHFGILLELSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 393 - protein, 225 aa, Homo sapiens [sequence omitted]

SEQ ID NO: 394 - protein, 114 aa, Homo sapiens
MRLQDRIATFFFPKGMMLTTAALMLFFLHLGIFIRDVHNFCITYHYDHMSFHYTVVLMFSQVISICWAAMGSLYAEMTENNAQRSHVLQPPVLGVSGHRVPGGAPLRPGESEQG

SEQ ID NO: 395 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMVKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 396 - protein, 279 aa, Homo sapiens
MPVCAPVLWRARRLCGMPVCAPVPWRARRLCTRAVVCPSSVPFIAGQGCTHMCKPATDPRFTRSPLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 397 - protein, 173 aa, Homo sapiens
MCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 398 - protein, 205 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 399 - protein, 180 aa, Homo sapiens
MWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQDLLKCTNTAK

SEQ ID NO: 400 - protein, 150 aa, Homo sapiens [sequence omitted]

SEQ ID NO: 401 - protein, 170 aa, Homo sapiens
MEDPNPEENMKQQDSPKERSPQSPGGNICHLGAPKCTRCLITFADSKFQERHMKREHPADFVAQKLQGVLFICFTCARSFPSSKALITHQRSHGPAAKPTLPVATTTAQPTFPCPDCGKTFGQAVSLRRHRQMHEVRAPPGTFACTECGQDFAQEAGLHQHYIRHARGEL

SEQ ID NO: 402 - protein, 169 aa, Homo sapiens
MEDPNPEENMKQQDSPKERSPQPRRQHLPPGGPEVHPLPHHLRRFQVPGASHEAGAPSGLRGPEAAGGPLHLLHLRPLLPLLQSPNHPPAQHGPAAKPTLPVATTTAQPTFPCPDCGKTFGQAVSLRRHRQMHEVRAPPGTFACTECGQDFAQEAGLHQHYIRHARGEL

SEQ ID NO: 403 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHLELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 404 - protein, 20 aa, Homo sapiens
MAAARPSLGRVLPGSSPVPV

SEQ ID NO: 405 - protein, 225 aa, Homo sapiens
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 406 - protein, 378 aa, Homo sapiens
MDPGDDWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLSSDGRLCLLDPRDLCHPVSSVQCPVSVPSPDPELLRVTWAPGLKNCLAISGFDGTVQVYDATSWDGTRSQDGTRSQVEPLFTHRGHIFLDGNGMDPAPLVTTHTWHPCRPRTLLSATNDASLHVWDWVDLCAPR

SEQ ID NO: 407 - protein, 43 aa, Homo sapiens
MATHALEIAGLFLGGVGMVGTVAVTVMPQWRVSAFIENNIVVF

SEQ ID NO: 408 - protein, 345 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGAALKAIIAMDTAGMILGWKFFDHAAHLGGALFGIWYVTYGHELIWKNREPLVKIWHEIRTNGPKKGGGSK

SEQ ID NO: 409 - protein, 236 aa, Homo sapiens
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSITILLLNFLRSHCFTQAMLSQPRMESLDTPAAYSLVLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 410 - protein, 121 aa, Homo sapiens
MNTEAEQQLLHHARNGNAEEVRQLLETMASNEVIADINCKGRSKSNLGWTPLHLACYFGHRQVVQDLLKAGAEVNVLNDMGDTPLHRAAFTGRKVKIILCSMFVSEVFGGVVTIVFSVITI

SEQ ID NO: 411 - protein, 170 aa, Homo sapiens
MRLQGAIFVLLPHLGPILVWLFTRDHMSGWCEGPRMLSWCPFYKVLLLVQTAIYSVVGYASYLVWKDLGGGLGWPLALPLGLYAVQLTISWTVLVLFFTVHNPGLALLHLLLLYGLVVSTALIWHPINKLAALLLLPYLAWLTVTSALTYHLWRDSLCPVHQPQPTEKSD

SEQ ID NO: 412 - protein, 236 aa, Homo sapiens [sequence omitted]

SEQ ID NO: 413 - protein, 191 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVFQQHAALKISSALKDSDLP

SEQ ID NO: 414 - protein, 389 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 415 - protein, 481 aa, Homo sapiens
MSLNLPEASLLSRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 416 - protein, 354 aa, Homo sapiens
MSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 417 - protein, 20 aa, Homo sapiens
MKGLYFQQSSTDEEITFVFQ

SEQ ID NO: 418 - protein, 320 aa, Homo sapiens
MKGLYFQQSSTDEEITFVFQEKEDLPVTEDNFVKLQVKACALSQINTKLLAEMKMKKDLFPVGREIAGIVLDVGSKVSFFQPDDEVVGILPLDSEDPGLCEVVRVHEHYLVHKPEKVTWTEAAGSIRDGVRAYTALHYLSHLSPGKSVLIMDGASAFGTIAIQLAHHRGAKVISTACSLEDKQCLERFRPPIARVIDVSNGKVHVAESCLEETGGLGVDIVLDAGVRLYSKDDEPAVKLQLLPHKHDIITLLGVGGHWVTTEENLQLDPPDSHCLFLKGATLAFLNDEVWNLSNVQQGKYLYLKGCDGEVINWCFQTSVG

SEQ ID NO: 419 - protein, 159 aa, Homo sapiens
MEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 420 - protein, 183 aa, Homo sapiens
MEQRLAEFRAARKRAGLAAQPPAASQGAQTPGEKAEAAATLKAAPGWLKRFLVWKPRPASARAQPGLVQEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 421 - protein, 143 aa, Homo sapiens
MAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 422 - protein, 73 aa, Homo sapiens
MSGVPAEMTGAVEAFLPVVSSSRRLPRFVHMVAGVSSKQERARSNTEALFKLCFHHICQCLTDEHKFHGQVQF

SEQ ID NO: 423 - protein, 142 aa, Homo sapiens [sequence omitted]

SEQ ID NO: 424 - protein, 149 aa, Homo sapiens
MLSILKPRRSQEWRTALRRYCCPTDLQAPRSPVPPIRKVGISDVIVHANLATSLKKNTCNCQADLLSWRSWVNGISCHCPNLRPLSKSIFRDSTSLCSLSQQRLCPLHSKPEACWGLFVSVHAHFRVQAGGRGNRVGKKTRVSRNDETL

SEQ ID NO: 425 - protein, 75 aa, Homo sapiens [sequence omitted]

SEQ ID NO: 426 - protein, 168 aa, Homo sapiens
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 427 - protein, 160 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRDRVSPCCPGWSQTPVILPPQPSEVLGLQMQAAVPEAHGEDRHSAPLCFRCVPGPCPVPGGGIPGPWH

SEQ ID NO: 428 - protein, 94 aa, Homo sapiens [sequence omitted]

SEQ ID NO: 429 - protein, 95 aa, Homo sapiens
MKASGPDLSDGLHCPSLIRHLRTFSAAAALAPRYPTRLPSSLLLWHLCQCLHLLYAVSTSCNSHGKRSAAWAMTRTEDTDALTDSFDDSFISSAD

SEQ ID NO: 430 - protein, 99 aa, Homo sapiens
MKKKEETTLSEMEPVEPQYQLVNAESTSPFLHCLREVIGEYSVHEFSLLGKTESQGIGLWIALVVFLSFLIFSTSFYISNAEQPFFKEPPTEAAKELSL

SEQ ID NO: 431 - protein, 122 aa, Homo sapiens
IRATMVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 432 - protein, 118 aa, Homo sapiens
MQPSLLRSYRLKAQLSLSSTVPRRITDKPATKSWEGGRRELCPRVLFTQLLLWVWPGDPGPELQETGFPGPPRPAHLKTDRAIMVGVKGIEEKSGIGAGVCRVSVEKLASTQERTSSL

SEQ ID NO: 433 - protein, 49 aa, Homo sapiens
MELEAMSRYTSPVNPPVFPHLTVVLLAIGMFFTAWFFVYPFTEQPEDQH

SEQ ID NO: 434 - protein, 89 aa, Homo sapiens
MLALFHFHLPPWDDAVRRPSVDASPSTLNFPDAELYASIFLCCMAPGEILISFLTLVQIAHANGRGCNTPACGAAACVWHENSQEERKY

SEQ ID NO: 435 - protein, 87 aa, Homo sapiens
MSQQHRRKRPSSERKSTRKMDTWQSLKVKEVFCKHNSSYECLLYKEVEARQVSKTATDGSYLLVFTSYVISSPVWTGPGDLLPVNRI

SEQ ID NO: 436 - protein, 45 aa, Homo sapiens
MPRSSRSPGDPGALLEDGPQSQTPEDCPARPEHQQDGRGHLPKHE

SEQ ID NO: 437 - protein, 65 aa, Homo sapiens
MAYLDDKGSLLAIHSHARQHSHETNQVHQWLPRNTFAFLIKEDRCSCRSTCASFSFSSSFSFLIS

SEQ ID NO: 438 - protein, 112 aa, Homo sapiens
MRKKCKCFTIKKTNTYEESNAGNEGQKEAISICICRRDGLLPLWVTRLSDLVFSKEKAHGMIPLLGSHREKKTSKEMKTSSRNLRYFIVCRDASSYTPQSLISGYIGPCQHQ

SEQ ID NO: 439 - protein, 110 aa, Homo sapiens
MVFGAMVLLVGLEELTNIRNVERLKKDLRASYCLIDSFLGDSELIGDLTQCVDCVIPPEGSLLQISSYLYLNTALVDLPGVAASQACDSQQVTWLLYVANGAYSACNRPG

SEQ ID NO: 440 - protein, 121 aa, Homo sapiens
TSSSGAEVTMAAALARLGLRPVKQVRVQFCPFEKNVESTRTFLQTVSSEKVRSTNLNCSVIADVRHDGSEPCVDVLFGDGHRLIMRGAHLTALEMLTAFASHIRARDAAGSGDKPGADTGR

SEQ ID NO: 441 - protein, 99 aa, Homo sapiens
MLARATFRAASAPTLVARRGFQSTRAQMASPYHYPEGPRSNLPFDPLKKGFAFKYWGFMGTGFALPFLLAVWQTEQAVNALRHGVDMRIGIPGNTAFVD

SEQ ID NO: 442 - protein, 183 aa, Homo sapiens
REGARARPSPTMSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKKK

SEQ ID NO: 443 - protein, 94 aa, Homo sapiens
MSDEASAITSYEKFLTPEEPFPLLGPPRGVGTCPSEEPGCLDISDFGCQLSSCHRTDPLHRFHTNRWNLTSCGTSVASSEGSEELFSSVCWRSR

SEQ ID NO: 444 - protein, 105 aa, Homo sapiens
IGPRAPSPSFSVRDVELSDPARERGEMPVAVGPYGQSQPSCFDRVKMGFVMGCAVGMAAGALFGTFSCLRIGMRGRELMGGIGKTMMQSGGTFGTFMAIGMGIRC

SEQ ID NO: 445 - protein, 163 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGVSQGPAQSQVEVSLGPGTDYRTLGKTLHCHVTQFPHLPDGCCCENYEMK

SEQ ID NO: 446 - protein, 128 aa, Homo sapiens
MEDKEIPIKSEPLPKPPASAPPSILVKPENSRNGIEKQVKTVRFQNYSPPPTKHYTSHPTSGKPEQPATLKASQPEAASLGPEMTVLFAHRSGCHSGQQTDLRRKSALAKATTLVSTASGTQTVFPSK

SEQ ID NO: 447 - protein, 96 aa, Homo sapiens
MLTRVEEQKKMVKACRYRCSACHLKYSPQRQKERKLSLKRGRTSQQNMSMFWLKKLLESGLFCAMCSPRASTKKGFWCRPKTTIIIIDYSSPRQCL

SEQ ID NO: 448 - protein, 160 aa, Homo sapiens
  UNSURE 114: Xaa = Glu,Val
  UNSURE 113: Xaa = His,Gln
  UNSURE 115: Xaa = Ile,Val
MGKIALQLKATLENITNLRPVGEDFRWYLKMKCGNCGEISDKWQYIRLMDSVALKGGRGSASMVQKCKLCARENSIEILSSTIKPYNAEDNENFKTIVEFECRGLEPVDFQPXXXLLLKVWSQGQPSVTLICRRRTGTDYDEKAQESVGIYEVTHQFVKC

SEQ ID NO: 449 - protein, 117 aa, Homo sapiens
MDSLAAGELNASHQPWVPEFVAYWRKTHQDHLCSLHSRAFGLLDARVTWALRRAPEPVPGKDRLLLAAFPAEASPVDTASVSVYGRAPRYMHKGVKKCVCTPVSKNSTAWLLLGGIS

SEQ ID NO: 450 - protein, 335 aa, Homo sapiens
MCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 451 - protein, 86 aa, Homo sapiens
  UNSURE 76: Xaa = Lys,Asn
MCWVINHAILPRMRMHSKRQTITRHSASLSFHALPRSAFLQLCLLRQIHQIPCLSIFSSTLRAQTHDSGIGCTTAXPGGRRQEQLR

SEQ ID NO: 452 - protein, 93 aa, Homo sapiens
MKIALCQRELPSPRSCLLSRDVTGVICTRMPRLAICSKTAQKALPCIPLLHTSPLCLQLLSAGLHIYATLCKSCASRNHKNIFLHLLHSLSAA

SEQ ID NO: 453 - protein, 108 aa, Homo sapiens
MAVRASFENNCEIGCFAKLTNTYCLVAIGGSENFYSVFEGELSDTIPVVHASIAGCRIIGRMCVGDRRNSGRCAQGGSLQTDSGRPGASRKLLCLQQSGRAGASQDFN

SEQ ID NO: 454 - protein, 277 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 455 - protein, 173 aa, Homo sapiens
MLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGSMALIIIDWIYDPPNSKHH

SEQ ID NO: 456 - protein, 370 aa, Homo sapiens
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 457 - protein, 393 aa, Homo sapiens
MTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 458 - protein, 116 aa, Homo sapiens
MVGGEAAAAVEELVSGVRQAADFAEQFRSYSESEKQWKARMEFILRHLPDYRDPPDGSGRLDQLLSLSMVWANHLFLGCSYNKDLLDKVMEMADGIEVEDLPQFTTRSELMKKHQS

SEQ ID NO: 459 - protein, 163 aa, Homo sapiens
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 460 - protein, 230 aa, Homo sapiens
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 461 - protein, 101 aa, Homo sapiens
  UNSURE 95: Xaa = Cys,Trp
MERPDKAALNALQPPEFRNESSLASTLKTLLFFTALMITVPIGLYFTTKSYIFEGALGMSNRDSYFYAAIVAVVAVHVVLALFVYVAWNEGSRQXREGKQD

SEQ ID NO: 462 - protein, 93 aa, Homo sapiens
MDSLRKMLISVAMLGAGAGVGYALLVIVTPGERRKQEMLKEMPLQDPRSREEAARTQQLLLATLQEAATTQENVAWRKNWMVGGEGGAGGRSP

SEQ ID NO: 463 - protein, 133 aa, Homo sapiens
MGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 464 - protein, 95 aa, Homo sapiens
MGHGDEIVLADLNFPASSICQCGPMEIRADGLGIPQLLEAVLAAAPGHLCGESGCSHGAGAQRQGEGPADPSVDGVRVHPTQGRLCESPGKDREV

SEQ ID NO: 465 - protein, 93 aa, Homo sapiens [sequence omitted]

SEQ ID NO: 466 - protein, 500 aa, Homo sapiens
MEVSTNPSSNIDPGNYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFMEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGRENKEPLHILHPQ

SEQ ID NO: 467 - protein, 140 aa, Homo sapiens [sequence omitted]

SEQ ID NO: 468 - protein, 100 aa, Homo sapiens
MYMLLSPHRLREQAGVRGSIRTANRTEDGLKIREAESLPQSNTADFKCLHSASLQQAPGGILMGPASSPWTLAVEGEKRTSAPPLRESLMPTKGLGWWTQ

SEQ ID NO: 469 - protein, 119 aa, Homo sapiens [sequence omitted]

SEQ ID NO: 470 - protein, 140 aa, Homo sapiens
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 471 - protein, 109 aa, Homo sapiens [sequence omitted]

SEQ ID NO: 472 - protein, 100 aa, Homo sapiens [sequence omitted]

SEQ ID NO: 473 - protein, 141 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 474 - protein, 134 aa, Homo sapiens
MATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 475 - protein, 134 aa, Homo sapiens
MATHPDGFRLEGPLAAAHSPGPCTVLYEGPVRGLCPFAPRNSNTMSAAALAAPSLGFDGVIGVLVADTSLTDMHVVDVELSGPRGPTCRSFAVHTRRENPAEPGAVTGSATVTAFWRSLLACCQLPSRPGIHLC

SEQ ID NO: 476 - protein, 85 aa, Homo sapiens
MLKVEATGSPEEGWAGGEPRTGAPANSPSCPQEMPLQDPRSREEAARTQQLLLATLQEAATTQENVAWRKNWMVGGEGGASGRSP

SEQ ID NO: 477 - protein, 116 aa, Homo sapiens
MGRPWMVMILESKSEEKMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 478 - protein, 104 aa, Homo sapiens [sequence omitted]

SEQ ID NO: 479 - protein, 439 aa, Homo sapiens
LGDHGWELSLEEDAQLWGGVVKSCFEGKGPQREAQPASPQAAPPGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 480 - protein, 116 aa, Homo sapiens
MWARLPHTPEQMGHRLIGPKEASLHVVPSWPARKMEGLLAGLSSSPRKSCWPFWVHGPKVHEGGSACETSSSWVEGLGLRRVTSVHSLCQGLGASVQLLPGPPPTTTSDKNNYTSG

SEQ ID NO: 481 - protein, 171 aa, Homo sapiens
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNE

SEQ ID NO: 482 - protein, 177 aa, Homo sapiens
MQPAERSRVPRIDPYGFERPEDFDDAAYEKFFSSYLVTLTRRAIKWSRLLQGGGVPRSRTVKRYVRKGVPLEHRARVWMVLSGAQAQMDQNPGYYHQLLQGERNPRLEDAIRTDLNRTFPDNVKFRKTTDPCLQRTLYNVLLAYGHHNQGVGYCQGMNFIAGYLILITNNDKNLFGC

What is claimed is:

1. A purified and isolated polypeptide comprising the amino acid sequence of SEQ ID NO: 399.

2. The polypeptide of claim 1, wherein said polypeptide consists of the amino acid sequence of SEQ ID NO: 399.

3. A purified and isolated polypeptide comprising an amino acid sequence encoded by a human cDNA of Clone 160-40-1-0-H4-CS in ATCC accession number PTA-1218.

4. The polypeptide of claim 1, wherein said polypeptide is a phosphatase.

5. The polypeptide of claim 3, wherein said polypeptide is a phosphatase.

6. The polypeptide of claim 4, wherein said polypeptide catalyzes the conversion of phosphatidic acid into diacylglycerol.

7. The polypeptide of claim 5, wherein said polypeptide catalyzes the conversion of phosphatidic acid into diacylglycerol.

* * * * *

UNITED STATES PATENT AND TRADEMARK OFFICE
CERTIFICATE OF CORRECTION

| | | |
|---|---|---|
| PATENT NO. | : 7,060,479 B2 | Page 1 of 10 |
| APPLICATION NO. | : 09/876997 | |
| DATED | : June 13, 2006 | |
| INVENTOR(S) | : Jean-Baptiste Dumas Milne Edwards, Lydie Bougueleret and Severin Jobert | |

It is certified that error appears in the above-identified patent and that said Letters Patent is hereby corrected as shown below:

Column 2,
Line 2, "ofter" should read --often--.

Column 12,
Line 61, "60/187" should read --60/187,470--.

Column 16,
Line 19, "96%, 96%, 98relative to" should read --96%, 96%, 98%, 99%, or 100% pure relative to--.

Column 22,
Line 18, "Randomization Group25" should read --Randomization Group 25,--.

Column 32,
Line 61, "present invention is a" should read --present invention are a--.

Column 35,
Line 29, "telomerc repeats" should read --telomeric repeats--.

Column 43,
Line 18, "either fill-length" should read --either full-length--.

Column 63,
Lines 35-36, "$5 \times 10^-{}_{15}M$" should read --$5 \times 10^{-15}M$--.

Column 83,
Line 36, "containing 25 ∞g/ml" should read --containing 25 µg/ml--.

Column 86,
Line 26, "between 0,1 and" should read --between 0.1 and--.

Column 95,
Line 37, "groups firm" should read --groups from--.

Column 99,
Line 19, "contain domain" should read --contain the LRR domain--.

Column 102,
Line 9, "chromatograpy" should read --chromatography--.

UNITED STATES PATENT AND TRADEMARK OFFICE
CERTIFICATE OF CORRECTION

| | |
|---|---|
| PATENT NO. | : 7,060,479 B2 |
| APPLICATION NO. | : 09/876997 |
| DATED | : June 13, 2006 |
| INVENTOR(S) | : Jean-Baptiste Dumas Milne Edwards, Lydie Bougueleret and Severin Jobert |

It is certified that error appears in the above-identified patent and that said Letters Patent is hereby corrected as shown below:

Column 103,
Line 5, "binding domain domain" should read --binding domain--.
Line 24, "zinc fingers domains" should read --zinc finger domains--.

Column 107,
Line 49, "shown to activates" should read --shown to activate--.

Column 108,
Line 10, "exemple" should read --example--.
Line 44, "immunohistochemisty" should read --immunohistochemistry--

Column 110,
Line 58, "extramacrochactac" should read --extramacrochaetae--.

Column 113,
Line 55, "invention havinf an" should read --invention having an--.

Column 127,
Lines 31-32, "is caracterized by" should read --is characterized by--.
Line 52, "plant epoxyde hydrolase" should read --plant epoxide hydrolase--.
Line 58, "hydratation" should read --hydration--.

Column 128,
Line 11, "may be associed with" should read --may be associated with--
Line 35, "an epoxyde hydrolase" should read --an epoxide hydrolase--.

Column 129,
Line 29, "Biochemistry 29 1425-1435" should read --Biochemistry 29:1425-1435--.
Line 60, "nutrient and gaz" should read --nutrient and gas--.

Column 130,
Line 26, "deficient fonction" should read --deficient function--.

Column 131,
Line 38, "that is the hallmarks" should read --that is the hallmark--.

Column 132,
Line 17, "participate to regulation" should read --participate in regulation--.

UNITED STATES PATENT AND TRADEMARK OFFICE
CERTIFICATE OF CORRECTION

| | | |
|---|---|---|
| PATENT NO. | : 7,060,479 B2 | |
| APPLICATION NO. | : 09/876997 | |
| DATED | : June 13, 2006 | |
| INVENTOR(S) | : Jean-Baptiste Dumas Milne Edwards, Lydie Bougueleret and Severin Jobert | |

It is certified that error appears in the above-identified patent and that said Letters Patent is hereby corrected as shown below:

<u>Column 133,</u>
Line 51, "immunohistochemisty" should read --immunohistochemistry--.

<u>Column 136,</u>
Lines 65-66, "and embryogenesis Individuals" should read --and embryogenesis. Individuals--.

<u>Column 140,</u>
Line 54, "alkali bums" should read --alkali burns--.

<u>Column 143,</u>
Line 10, "treatment of bums" should read --treatment of burns--.
Line 13, "healing of bums. The bums" should read --healing of burns. The burns--.
Line 17, "there are bums" should read --there are burns--.
Line 18, "contacting the bum" should read --contacting the burn--.

<u>Column 146,</u>
Line 25, "thuman pancreatic" should read --human pancreatic--.

<u>Column 149,</u>
Lines 36-37, "Kaun et Saier," should read --Kaun and Saier--.

<u>Column 150,</u>
Line 4, "Kaun et Saier" should read --Kaun and Saider--.

<u>Column 153,</u>
Lines 34-35, "composition and methods" should read --compositions and methods--.

<u>Column 155,</u>
Line 32, "donnor" should read --donor--.

<u>Column 156,</u>
Line 37, "celullar proteins" should read --cellular proteins--.

<u>Column 157,</u>
Line 62, "fusosyltransferase" should read --fucosyltransferase--.

UNITED STATES PATENT AND TRADEMARK OFFICE
CERTIFICATE OF CORRECTION

PATENT NO. : 7,060,479 B2
APPLICATION NO. : 09/876997
DATED : June 13, 2006
INVENTOR(S) : Jean-Baptiste Dumas Milne Edwards, Lydie Bougueleret and Severin Jobert It is certified that error appears in the above-identified patent and that said Letters Patent is hereby corrected as shown below:

Column 159,
Line 5, "model of" should read --models of--.
Line 11, "fusosyltransferase" should read --fucosyltransferase--.
Line 21, "or pat thereof" should read --or part thereof--.
Line 55, "related to" should read --relates to--.

Column 160,
Line 47, "immunohistochemisty" should read --immunohistochemistry--.

Column 164,
Line 15, "framents thereof" should read --fragments thereof--.

Column 168,
Line 15, "chromatograpy" should read --"chromatography--

Column 173,
Line 12, "exemple" should read --example--.
Line 23, "exemple" should read --example--.

Column 174,
Line 36, "relulation" should read --regulation--.

Column 177,
Line 16, "immunohistochemisty" should read --immunohistochemistry--.
Line 29, "U.S. Pat. No. 552,277" should read --U.S. Pat. No. 5,552,277--.

Column 186,
Line 30, "$p34^{SEI-}$ seems" should read --$p34^{SEI-1}$ seems--.

Column 191,
Line 6, "purified the protein" should read --purified protein--.

Column 192,
Line 51, "SEQ ID NO: HOPP" should read --SEQ ID NO: 259--.

Column 193,
Line 37, "methods Kohler" should read --methods of Kohler--.

Column 195,
Line 27, "clone 15 188-28-4-0-B12-CS" should read --clone 188-28-4-0-B12-CS--.

UNITED STATES PATENT AND TRADEMARK OFFICE
CERTIFICATE OF CORRECTION

| | |
|---|---|
| PATENT NO. | : 7,060,479 B2 |
| APPLICATION NO. | : 09/876997 |
| DATED | : June 13, 2006 |
| INVENTOR(S) | : Jean-Baptiste Dumas Milne Edwards, Lydie Bougueleret and Severin Jobert |

It is certified that error appears in the above-identified patent and that said Letters Patent is hereby corrected as shown below:

Column 198,
Line 59, "to functions as" should read --to function as--.

Column 201,
Line 8, "conserved cysteines residues" should read --conserved cysteine residues--.

Column 206,
Line 66, "memebers" should read --members--.

Column 209,
Lines 31-32, "metastatispreferably brain cancer" should read --metastasis, preferably brain cancer--.

Column 211,
Line 21, "trought its" should read --through its--.

Column 212,
Line 49, "eucaryote" should read --eukaryote--.
Line 54, "procaryote" should read --prokaryote--.

Column 213,
Line 42, "neuromuscularjunction" should read --neuromuscular junction--.

Column 217,
Line 29, "marquer" should read --marker--.
Line 52, "postherpetic" should read --post-therapeutic--.

Column 223,
Line 31, "gliobastoma" should read --glioblastoma--.
Line 48, "fragments thereof Further preferred" should read --fragments thereof. Further preferred--.

Column 224,
Line 37, "In further" should read --In a further--.

Column 225,
Line 1, "in further" should read --in a further--.
Line 19, "In further" should read --In a further--.

UNITED STATES PATENT AND TRADEMARK OFFICE
CERTIFICATE OF CORRECTION

| | |
|---|---|
| PATENT NO. | : 7,060,479 B2 |
| APPLICATION NO. | : 09/876997 |
| DATED | : June 13, 2006 |
| INVENTOR(S) | : Jean-Baptiste Dumas Milne Edwards, Lydie Bougueleret and Severin Jobert |

It is certified that error appears in the above-identified patent and that said Letters Patent is hereby corrected as shown below:

Column 226,
Line 6, "gliobastoma" should read --glioblastoma--.
Line 19, "gliobastoma" should read --glioblastoma--.

Column 234,
Lines 17-18, "Golgi cistemae" should read --Golgi cisternae--.

Column 237,
Line 62, "gliobastoma" should read --glioblastoma--.

Column 239,
Line 1, "In further" should read --In a further--.
Line 32, "in further" should read --in a further--.
Line 50, "In further" should read --In a further--.

Column 240,
Line 37, "gliobastoma" should read --glioblastoma--.
Line 50, "gliobastoma" should read --glioblastoma--.

Column 241,
Line 49, "neurogenerative" should read --neurodegenerative--.
Line 60, "provide methods" should read --provides methods--.

Column 242,
Lines 15-16, "neurogenerative" should read --neurodegenerative--.
Lines 64-65, "neurogenerative" should read --neurodegenerative--.

Column 244,
Line 61, "int the" should read --in the--.

Column 246,
Line 3, "Cterminal" should read --C terminal--.

Column 249,
Line 10, "Pancreas :139-149" should read --Pancreas 9(2):139-149--.

Column 251,
Line 4, "chromatograpy" should read --chromatography--.
Line 4, "prepartation" should read --preparation--.
Line 57, "(1993" should read --(1993)--.

UNITED STATES PATENT AND TRADEMARK OFFICE
CERTIFICATE OF CORRECTION

PATENT NO. : 7,060,479 B2
APPLICATION NO. : 09/876997
DATED : June 13, 2006
INVENTOR(S) : Jean-Baptiste Dumas Milne Edwards, Lydie Bougueleret and Severin Jobert It is certified that error appears in the above-identified patent and that said Letters Patent is hereby corrected as shown below:

Column 257,
Line 66, "In further" should read --In a further--.

Column 258,
Line 9, "In further" should read --In a further--.
Line 23, "In further" should read --In a further--.

Column 260,
Line 6, "In further" should read --In a further--.
Line 9, "In further" should read --In a further--.

Column 263,
Line 4, "diarrhoea" should read --diarrhea--.

Column 265,
Line 15, "CO2 hydration" should read --$CO_2$ hydration--.
Line 26, "CO2 hydration" should read --$CO_2$ hydration--.

Column 267,
Line 53, "chromatograpy" should read --chromatography--.

Column 268,
Line 52, "doamins" should read --domains--.

Column 275,
Line 4, "frombrain" should read --from brain--.
Line 28, "chromatograpy" should read --chromatography--.

Column 281,
Line 22, "chromatograpy" should read --chromatography--.
Line 23, "prepartation" should read --preparation--.
Line 65, "exon2" should read --exon 2--.

Column 282,
Line 3, "intron1" should read --intron 1--.
Line 20, "differenctiation" should read --differentiation--.
Line 44, "Some throughly studied" should read --Some thoroughly studied--.
Line 47, "et Al reported" should read --et al. reported--.

UNITED STATES PATENT AND TRADEMARK OFFICE
CERTIFICATE OF CORRECTION

| | | |
|---|---|---|
| PATENT NO. | : 7,060,479 B2 | |
| APPLICATION NO. | : 09/876997 | |
| DATED | : June 13, 2006 | |
| INVENTOR(S) | : Jean-Baptiste Dumas Milne Edwards, Lydie Bougueleret and Severin Jobert | |

It is certified that error appears in the above-identified patent and that said Letters Patent is hereby corrected as shown below:

Column 283,
Line 61, "chromatograpy" should read --chromatography--.
Line 61, "prepartation" should read --preparation--.

Column 292,
Line 29, "bum healing" should read --burn healing--.

Column 293,
Line 21, "polypeptidehas" should read --polypeptide has--.

Column 294,
Line 63, "demntia" should read --dementia--.

Column 295,
Line 61, "comichon" should read --cornichon--.

Column 297,
Line 32, "demntia" should read --dementia--.

Column 300,
Line 26, "twomembrane-spanning" should read --two membrane-spanning--.

Column 303,
Line 41, "particulary" should read --particularly--.

Column 304,
Line 61, "svere" should read --severe--.

Column 309,
Line 34, "Croh's disease" should read --Crohn's disease--.

Column 314,
Line 45, "enzymes labels" should read --enzyme labels--.

Column 322,
Line 10, "Protiens of" should read --Protein of--.

UNITED STATES PATENT AND TRADEMARK OFFICE
CERTIFICATE OF CORRECTION

| | |
|---|---|
| PATENT NO. | : 7,060,479 B2 |
| APPLICATION NO. | : 09/876997 |
| DATED | : June 13, 2006 |
| INVENTOR(S) | : Jean-Baptiste Dumas Milne Edwards, Lydie Bougueleret and Severin Jobert |

It is certified that error appears in the above-identified patent and that said Letters Patent is hereby corrected as shown below:

Column 324,
Line 12, "embodiment, The" should read --embodiment, the--.

Column 336,
Line 4, "specifically bine the" should read --specifically bind the--.

Column 342,
Line 48, "potasssium" should read --potassium--.

Column 347,
Line 66, "specifically binds a" should read --specifically bind a--.

Column 351,
Line 25, "compartments/organelels" should read --compartments/organelles--.

Column 353,
Line 28, "(e.g. biopsies." should read --(e.g. biopsies).--.

Column 355,
Line 13, "Diphteria toxin A" should read --Diphtheria toxin A--.

Column 367,
Line 12, "biological activty" should read --biological activity--.

Column 372,
Line 35, "titaniumdioxide" should read --titanium dioxide--.

Column 376,
Line 2, "manipule" should read --manipulate--.

Column 394,
Lines 47-48, "Muller et al. I Eur. J." should read --Muller et al. Eur. J.--.

UNITED STATES PATENT AND TRADEMARK OFFICE
CERTIFICATE OF CORRECTION

PATENT NO. : 7,060,479 B2
APPLICATION NO. : 09/876997
DATED : June 13, 2006
INVENTOR(S) : Jean-Baptiste Dumas Milne Edwards, Lydie Bougueleret and Severin Jobert It is certified that error appears in the above-identified patent and that said Letters Patent is hereby corrected as shown below:

Column 433,
Table Vb, SEQ ID NO: 166, "1-1];" should read --[1-1];--.

Signed and Sealed this

Twenty Second Day of April, 2008

JON W. DUDAS
*Director of the United States Patent and Trademark Office*